US011359246B2

(12) United States Patent
Lotta et al.

(10) Patent No.: US 11,359,246 B2
(45) Date of Patent: Jun. 14, 2022

(54) TREATMENT OF OBESITY WITH G-PROTEIN COUPLED RECEPTOR 75 (GPR75) INHIBITORS

(71) Applicant: Regeneran Pharmaceuticals, Inc., Tarrytown, NY (US)

(72) Inventors: Luca Andrea Lotta, Tarrytown, NY (US); Manuel Allen Revez Ferreira, Tarrytown, NY (US); Aris Baras, Tarrytown, NY (US); Parsa Akbari, Tarrytown, NY (US); Olukayode Sosina, Tarrytown, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 0 days.

(21) Appl. No.: 17/353,313

(22) Filed: Jun. 21, 2021

(65) Prior Publication Data

US 2022/0042101 A1 Feb. 10, 2022

Related U.S. Application Data

(60) Provisional application No. 63/042,327, filed on Jun. 22, 2020, provisional application No. 63/066,185, filed on Aug. 15, 2020, provisional application No. 63/075,858, filed on Sep. 9, 2020, provisional application No. 63/089,625, filed on Oct. 9, 2020, provisional application No. 63/104,613, filed on Oct. 23, 2020, provisional application No. 63/142,632, filed on Jan. 28, 2021, provisional application No. 63/159,017, filed on Mar. 10, 2021, provisional application No. 63/210,287, filed on Jun. 14, 2021, provisional application No. 63/211,061, filed on Jun. 16, 2021.

(51) Int. Cl.
*C12Q 1/6883* (2018.01)
*A61P 3/04* (2006.01)
*A61K 31/7105* (2006.01)
*A61K 38/46* (2006.01)
*C12N 15/113* (2010.01)

(52) U.S. Cl.
CPC ........ *C12Q 1/6883* (2013.01); *A61K 31/7105* (2013.01); *A61K 38/465* (2013.01); *A61P 3/04* (2018.01); *C12N 15/1138* (2013.01); *C12N 2310/11* (2013.01); *C12N 2310/14* (2013.01); *C12Q 2600/106* (2013.01); *C12Q 2600/156* (2013.01)

(58) Field of Classification Search
CPC .......................... C12Q 1/6883; C07K 14/723; C12N 2310/14; C12N 2310/20
See application file for complete search history.

(56) References Cited

U.S. PATENT DOCUMENTS

| 8,185,323 | B1 | 5/2012 | Zhou |
| 10,446,261 | B1 | 10/2019 | Zhuo |
| 2008/0108080 | A1* | 5/2008 | Chissoe ............... C12Q 1/6883 |
| | | | 435/6.11 |
| 2008/0108145 | A1 | 5/2008 | Chissoe |
| 2010/0113297 | A1 | 5/2010 | Lidereau et al. |
| 2011/0177964 | A1 | 7/2011 | Broach et al. |
| 2014/0377278 | A1 | 12/2014 | Elinav et al. |
| 2016/0169918 | A1 | 6/2016 | Murray et al. |
| 2018/0100201 | A1 | 4/2018 | Garraway et al. |
| 2019/0117689 | A1 | 4/2019 | Balin et al. |
| 2019/0241633 | A1 | 8/2019 | Fotin-Mleczek et al. |
| 2020/0030291 | A1* | 1/2020 | Falck .................... C07D 257/04 |
| 2020/0113950 | A1 | 4/2020 | Cohen et al. |
| 2020/0207836 | A1 | 7/2020 | Pfleger et al. |
| 2021/0002296 | A1 | 1/2021 | Mainolfi et al. |
| 2021/0283262 | A1 | 9/2021 | Dominy et al. |

FOREIGN PATENT DOCUMENTS

| WO | 2005040790 | 5/2005 |
| WO | 2013036290 | 3/2013 |
| WO | 2017132291 | 8/2017 |
| WO | 2017156164 | 9/2017 |
| WO | 2020118363 | 6/2020 |
| WO | 2020247220 | 12/2020 |

OTHER PUBLICATIONS

LOVD3 (2020; Whole genome datasets GPR75 (G protein-coupled receptor 75) on the web at databases.lovd.nl/whole_genome/view/GPR75, pp. 1-3.*
Dewey et al., "Distribution and clinical impact of functional variants in 50,726 whole-exome sequences from the DiscovEHR Study", Science, 2016, 354(6319), pp. aaf6814.
Garcia et al., "20-HETE Signals Through G-Protein-Coupled Receptor GPR75 (Gq) to Affect Vascular Function and Trigger Hypertension", Circ Res, 2017, 120, pp. 1776-1788.
Pappalardo et al., "A Whole-Genome RNA Interference Screen Reveals a Role for Spry2 in Insulin Transcription and the Unfolded Protein Response", Diabetes, 2017, 66, pp. 1703-1712.
Sauer et al., "Evaluation of the G Protein Coupled Receptor-75 (GPR75) in Age Related Macular Degeneration", British Journal of Opthalmology, 2001, 85(8), pp. 969-975.
Dedoni et al., "The orphan G-protein-coupled receptor 75 signaling is activated by the chemokine CCL5", Journal of Neurochemistry, 2018, 146(5), pp. 526-539.

(Continued)

*Primary Examiner* — Karen Cochrane Carlson
(74) *Attorney, Agent, or Firm* — Stradley Ronon Stevens & Young, LLP

(57) ABSTRACT

The present disclosure provides methods of treating subjects having obesity, methods of identifying subjects having an increased risk of developing obesity, methods of detecting human G-protein coupled receptor 75 variant nucleic acid molecules and variant polypeptides, and GPR75 variant nucleic acid molecules and variant polypeptides.

29 Claims, 47 Drawing Sheets

Specification includes a Sequence Listing.

(56) References Cited

OTHER PUBLICATIONS

Liu et al., "The novel chemokine receptor, G-protein-coupled receptor 75, is expressed by islets and is coupled to stimulation of insulin secretion and improved glucose homeostasis", Diabetologia, 2013, 56(11), pp. 2467-2476.

Taneera et al., "Orphan G-Protein coupled receptor 183 (GPR183) potentiates insulin secretion and prevents glucotoxicity-induced [beta]-cell dysfunction", Molecular and Cellular Endocrinology, 2020, 499, pp. 1-9.

* cited by examiner

| Variable | UKB study (N=428,719) | GHS study (N=121,061) | MCPS study (N=95,846) |
|---|---|---|---|
| Age, mean (SD) in years | 57 (8) | 53 (17) | 52 (13) |
| Women, N (%) | 232,553 (54) | 73,769 (61) | 65,330 (68) |
| Body mass index, mean (SD) in kg/m² | 27.4 (4.8) | 31.1 (7.3) | 29.1 (5.1) |
| Body weight, mean (SD) in kg | 78 (16) | 88 (23) | 70 (14) |
| Body mass index WHO categories, N (%) | | | |
| Underweight (< 18.5 kg/m²) | 2,089 (0.49) | 994 (0.82) | 499 (0.52) |
| Healthy weight (18.5 to < 25 kg/m²) | 140,175 (32.70) | 23,784 (19.65) | 18,599 (19.41) |
| Overweight (25 to < 30 kg/m²) | 182,564 (42.58) | 35,787 (29.56) | 40,672 (42.43) |
| Obesity, non-severe (30 to < 40 kg/m²) | 95,928 (22.37) | 46,067 (38.05) | 33,203 (34.64) |
| Severe obesity (≤ 40 kg/m²) | 7,963 (1.86) | 14,429 (11.92) | 2,873 (3.00) |
| Blood pressure, mean (SD) in mmHg | | | |
| Systolic | 138 (19) | 124 (11) | 127 (17) |
| Diastolic | 82 (11) | 74 (7) | 83 (10) |
| Low-density lipoprotein cholesterol, mean (SD) in mg/dL | 138 (34) | 107 (29) | Not measured |
| Triglycerides, median (IQR) in mg/dL | 132 (93, 191) | 124 (90, 172) | Not measured |

Figure 1

| Gene | Genetic exposure, variant type; allele frequency cut-off in % | Study | Beta (95% CI) per allele in SD units of BMI | p | AAF, fraction of 1 | Genotype counts, RR\|RA\|AA genotypes |
|---|---|---|---|---|---|---|
| GPR75 | pLOF; AAF < 1% | UKB | -0.34 (-0.49, -0.19) | 6.6E-06 | 0.0002 | 428,572\|147\|0 |
| GPR75 | pLOF; AAF < 1% | MCPS | -0.48 (-0.82, -0.13) | 7.1E-03 | 0.0002 | 95,816\|30\|0 |
| GPR75 | pLOF; AAF < 1% | GHS | -0.27 (-0.52, -0.02) | 3.6E-02 | 0.0002 | 121,010\|15\|0 |

Figure 2

| Gene | Genomic Coordinates | Genetic exposure, variant type; frequency cut-off in % | Beta (95% CI) per allele in SD units of BMI | p |
|---|---|---|---|---|
| GPR75 | 2: 53853133 | pLOF; AAF < 1% | -0.34 (-0.46, -0.22) | $2.6 \times 10^{-08}$ |

| Gene | AAF, fraction of 1 | Genotype counts, RR\|RA\|AA genotypes | Beta (95% CI) per allele in kg/m² units of BMI | Beta (95% CI) per allele in kgs of body weight | Beta (95% CI) per allele in lbs of body weight |
|---|---|---|---|---|---|
| GPR75 | 0.0002 | 645,398\|228\|0 | -1.8 (-2.5, -1.2) | -5.3 (-7.1, -3.4) | -11.6 (-15.7, -7.5) |

Figure 3

| Genetic exposure, variant type; frequency cutoff in % | Group | Beta (95% CI) per allele in SD units of BMI | Beta (95% CI) per allele in kg/m² units of BMI | p | AAF, fraction of 1 | Genotype counts, RR\|RA\|AA genotypes | p-value for heterogeneity in effect estimates between groups |
|---|---|---|---|---|---|---|---|
| GPR75 pLOF; AAF < 1% | Age ≤ median value in cohort | -0.33 (-0.50, -0.17) | -1.80 (-2.70, -0.89) | 1.0E-04 | 0.0002 | 331,175\|117\|0 | 0.93 |
| GPR75 pLOF; AAF < 1% | Age > median value in cohort | -0.35 (-0.52, -0.18) | -1.90 (-2.80, -0.95) | 7.8E-05 | 0.0002 | 314,223\|111\|0 | |
| GPR75 pLOF; AAF < 1% | Men | -0.35 (-0.55, -0.16) | -1.90 (-3.00, -0.86) | 3.5E-04 | 0.0002 | 273,885\|89\|0 | 0.91 |
| GPR75 pLOF; AAF < 1% | Women | -0.33 (-0.49, -0.18) | -1.80 (-2.60, -0.97) | 2.4E-05 | 0.0002 | 371,513\|139\|0 | |

Figure 5

| Gene | Genetic exposure, variant type; allele frequency cut-off in % | Per-allele OR (95% CI) for obesity | p | AAF, fraction of 1 | Genotype counts (cases), RR\|RA\|AA genotypes | Genotype counts (controls), RR\|RA\|AA genotypes |
|---|---|---|---|---|---|---|
| GPR75 | pLOF; AAF < 1% | 0.46 (0.31, 0.67) | 6.9E-05 | 0.0002 | 200,613\|45\|0 | 186,335\|94\|0 |

Figure 6

| Genetic exposure; variant type; frequency cutoff in % | Outcome | AAF, fraction of 1 | OR (95% CI) per allele | p | Genotype counts (cases), RR\|RA\|AA genotypes | Genotype counts (controls), RR\|RA\|AA genotypes |
|---|---|---|---|---|---|---|
| GPR75 pLOF; AAF < 1% | Responded "Thinner" to multiple choice question: "When you were 10 years old, compared to average would you describe yourself as: thinner, plumper, about average, do not know, prefer not to answer?" | 1.7E-04 | 1.66 (1.18, 2.34) | 3.9E-03 | 141,442\|62\|0 | 282,026\|82\|0 |

Figure 8

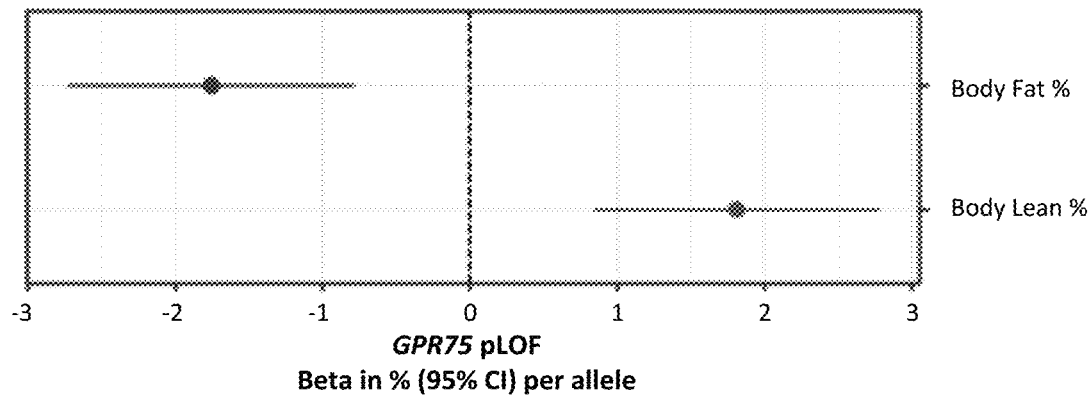
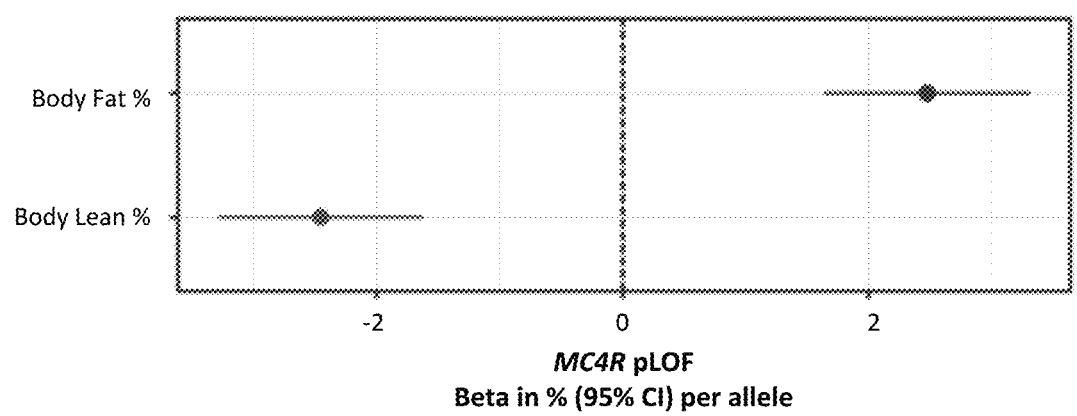
Figure 9 (cont.)

| Exposure | Outcome, clinical unit | Beta in SDs or odds ratio (95% CI) per allele | p | Allele counts participants (or disease cases for binary traits), RR\|RA\|AA | Allele counts controls, RR\|RA\|AA | Beta in clinical units (95% CI) per allele |
|---|---|---|---|---|---|---|
| GPR75 pLOF genetic variants, AAF < 1% | Glucose[a], mg/dL | -0.04 (-0.19, 0.11) | 5.8E-01 | 461,056\|162\|0 | - | -0.9 (-4.1, 2.3) |
| | HbA1c, % | -0.06 (-0.19, 0.07) | 3.5E-01 | 574,999\|191\|0 | - | -0.06 (-0.17, 0.06) |
| | AST[a], U/L | -0.01 (-0.15, 0.13) | 9.0E-01 | 515,532\|182\|0 | - | -0.1 (-1.4, 1.3) |
| | ALT[a], U/L | -0.11 (-0.25, 0.03) | 1.2E-01 | 518,135\|182\|0 | - | -1.5 (-3.4, 0.4) |
| | Triglycerides[a], mg/dL | -0.05 (-0.19, 0.08) | 4.4E-01 | 501,508\|178\|0 | - | -4.8 (-16.7, 7.2) |
| | HDL-C[a], mg/dL | 0.19 (0.05, 0.33) | 6.3E-03 | 467,058\|167\|0 | - | 2.9 (0.8, 4.9) |
| | LDL-C[a], mg/dL | -0.02 (-0.15, 0.12) | 7.9E-01 | 500,249\|177\|0 | - | -0.6 (-5.2, 3.9) |
| | Systolic blood pressure, mmHg | -0.03 (-0.15, 0.08) | 5.8E-01 | 622,080\|222\|0 | - | -0.6 (-2.7, 1.5) |
| | Diastolic blood pressure, mmHg | -0.03 (-0.15, 0.1) | 6.5E-01 | 618,264\|222\|0 | - | -0.3 (-1.6, 1) |
| | Waist-to-hip ratio, ratio units | -0.13 (-0.27, 0.01) | 8.0E-02 | 525,809\|177\|0 | - | -0.011 (-0.024, 0.001) |
| | Type 2 diabetes | 0.92 (0.59, 1.45)[b] | 7.3E-01 | 63,468\|24\|0 | 549,770\|191\|0 | - |

Figure 10

| Variant (CPRA) | AAF | cDNA change HGVS | Protein change HGVS | Affected exon | In genotyping array | In raw imputed data | Imputation quality INFO score, fraction of 1ª |
|---|---|---|---|---|---|---|---|
| 2:53853134:T:G | 2.3E-06 | c.1623A>C | p.Ter541Tyrext*? | Exon 2 | No | No | - |
| 2:53853135:T:G | 1.2E-06 | c.1622A>C | p.Ter541Serext*? | Exon 2 | No | No | - |
| 2:53853136:A:C | 2.3E-06 | c.1621T>G | p.Ter541Gluext*? | Exon 2 | No | No | - |
| 2:53853200:GGT:G | 7.6E-06 | c.1555_1556delAC | p.Thr519fs | Exon 2 | No | No | - |
| 2:53853245:GT:G | 1.2E-06 | c.1511delA | p.Asn504fs | Exon 2 | No | No | - |
| 2:53853256:G:A | 1.2E-06 | c.1501C>T | p.Gln501* | Exon 2 | No | No | - |
| 2:53853352:G:A | 1.3E-05 | c.1405C>T | p.Gln469* | Exon 2 | No | No | - |
| 2:53853354:CCA:C | 5.4E-05 | c.1401_1402delTG | p.Cys467fs | Exon 2 | No | No | - |
| 2:53853382:TG:T | 1.8E-05 | c.1374delC | p.Lys459fs | Exon 2 | No | No | - |
| 2:53853502:T:A | 5.8E-06 | c.1255A>T | p.Arg419* | Exon 2 | No | No | - |
| 2:53853535:G:A | 1.4E-05 | c.1222C>T | p.Arg408* | Exon 2 | No | No | - |
| 2:53853547:T:A | 1.0E-05 | c.1210A>T | p.Lys404* | Exon 2 | No | No | - |
| 2:53853560:G:GA | 1.2E-06 | c.1196dupT | p.Cys400fs | Exon 2 | No | No | - |
| 2:53853641:GTT:G | 9.0E-06 | c.1114_1115delAA | p.Asn372fs | Exon 2 | No | No | - |
| 2:53853680:CAATTCAAACTGGT:C | 1.2E-06 | c.1064_1076delACCAGTTTGAATT | p.Tyr355fs | Exon 2 | No | No | - |
| 2:53853692:G:T | 1.2E-06 | c.1065C>A | p.Tyr355* | Exon 2 | No | No | - |

Figure 12

| Variant (CPRA) | AAF | cDNA change HGVS | Protein change HGVS | Affected exon | In genotyping array | In raw imputed data | Imputation quality INFO score, fraction of 1a |
|---|---|---|---|---|---|---|---|
| 2:53853730:G:A | 3.5E-06 | c.1027C>T | p.Gln343* | Exon 2 | No | No | - |
| 2:53853771:G:C | 2.1E-05 | c.986C>G | p.Ser329* | Exon 2 | No | No | - |
| 2:53853853:G:A | 5.1E-06 | c.904C>T | p.Arg302* | Exon 2 | No | No | - |
| 2:53853877:G:A | 7.3E-05 | c.880C>T | p.Gln294* | Exon 2 | No | No | - |
| 2:53853926:G:T | 1.8E-05 | c.831C>A | p.Tyr277* | Exon 2 | No | No | - |
| 2:53853927:T:TA | 1.2E-06 | c.829dupT | p.Tyr277fs | Exon 2 | No | No | - |
| 2:53853946:G:GT | 2.3E-06 | c.810_811insA | p.Leu271fs | Exon 2 | No | No | - |
| 2:53853967:TGG:T | 4.7E-06 | c.788_789delCC | p.Pro263fs | Exon 2 | No | No | - |
| 2:53854009:G:A | 1.2E-06 | c.748C>T | p.Gln250* | Exon 2 | No | No | - |
| 2:53854037:A:AG | 4.7E-06 | c.719dupC | p.Val241fs | Exon 2 | No | No | - |
| 2:53854045:ACTTT:A | 1.7E-05 | c.708_711delAAAG | p.Arg236fs | Exon 2 | No | No | - |
| 2:53854051:T:A | 9.3E-06 | c.706A>T | p.Arg236* | Exon 2 | No | No | - |
| 2:53854057:G:A | 2.9E-05 | c.700C>T | p.Gln234* | Exon 2 | No | Yes, but excluded after QC due to very low imputation quality | 0.007 |
| 2:53854078:G:A | 5.2E-06 | c.679C>T | p.Gln227* | Exon 2 | No | No | - |
| 2:53854099:CAG:C | 3.5E-06 | c.656_657delCT | p.Ser219fs | Exon 2 | No | No | - |

Figure 12 (cont.)

| Variant (CPRA) | AAF | cDNA change HGVS | Protein change HGVS | Affected exon | In genotyping array | In raw imputed data | Imputation quality INFO score, fraction of 1[a] |
|---|---|---|---|---|---|---|---|
| 2:53854135:CAT:C | 1.2E-06 | c.620_621delAT | p.Tyr207fs | Exon 2 | No | No | - |
| 2:53854137:TAGAG:T | 1.7E-05 | c.616_619delCTCT | p.Leu206fs | Exon 2 | No | No | - |
| 2:53854306:G:A | 1.2E-05 | c.451C>T | p.Gln151* | Exon 2 | No | No | - |
| 2:53854380:G:C | 2.1E-06 | c.377C>G | p.Ser126* | Exon 2 | No | No | - |
| 2:53854409:A:AG | 7.6E-06 | c.347dupC | p.Cys118fs | Exon 2 | No | No | - |
| 2:53854421:ACTACTGG:A | 1.2E-05 | c.329_335delCCAGTAG | p.Ala110fs | Exon 2 | No | No | - |
| 2:53854474:C:A | 1.2E-05 | c.283G>T | p.Gly95* | Exon 2 | No | No | - |
| 2:53854476:C:CA | 1.2E-06 | c.280dupT | p.Cys94fs | Exon 2 | No | No | - |
| 2:53854485:AG:A | 1.2E-06 | c.271delC | p.Leu91fs | Exon 2 | No | No | - |
| 2:53854644:TG:T | 4.2E-05 | c.112delC | p.His38fs | Exon 2 | No | No | - |
| 2:53854685:TC:T | 5.2E-06 | c.71delG | p.Gly24fs | Exon 2 | No | No | - |
| 2:53854695:G:T | 1.2E-06 | c.62C>A | p.Ser21* | Exon 2 | No | No | - |
| 2:53854740:TG:T | 1.2E-06 | c.16delC | p.His6fs | Exon 2 | No | No | - |
| 2:53854755:A:G | 9.0E-06 | c.2T>C | p.Met1? | Exon 2 | No | No | - |
| 2:53859827:C:T | 1.2E-06 | c.-110+1G>A | - | Exon 1 | No | No | - |

Figure 12 (cont.)

| Gene | Genetic exposure, variant type; frequency cutoff in % | AAF, fraction of 1 | Beta (95% CI) per allele in SD units of BMI | Beta (95% CI) per allele in kg/m2 units of BMI | p | Genotype counts, RR\|RA\|AA genotypes |
|---|---|---|---|---|---|---|
| ASB3 | pLOF; AAF < 1% | 0.00015 | -0.037 (-0.17, 0.091) | -0.2 (-0.9, 0.49) | 0.57 | 645,432\|194\|0 |
| ASB3 | pLOF plus any missense; AAF < 0.1% | 0.00467 | -0.0081 (-0.031, 0.015) | -0.044 (-0.17, 0.082) | 0.50 | 639,601\|6,023\|2 |
| ASB3 | pLOF plus any missense; AAF < 1% | 0.01375 | -0.0069 (-0.021, 0.0068) | -0.037 (-0.11, 0.037) | 0.33 | 627,913\|17,677\|36 |
| ASB3 | pLOF plus deleterious missense (5/5); AAF < 0.1% | 0.00015 | -0.037 (-0.17, 0.091) | -0.2 (-0.9, 0.49) | 0.57 | 645,432\|194\|0 |
| ASB3 | pLOF plus deleterious missense (5/5); AAF < 1% | 0.00015 | -0.037 (-0.17, 0.091) | -0.2 (-0.9, 0.49) | 0.57 | 645,432\|194\|0 |
| ASB3 | pLOF plus deleterious missense (1/5); AAF < 0.1% | 0.00355 | -0.019 (-0.045, 0.0079) | -0.1 (-0.25, 0.042) | 0.17 | 641,041\|4,583\|2 |
| ASB3 | pLOF plus deleterious missense (1/5); AAF < 1% | 0.01150 | -0.011 (-0.026, 0.0039) | -0.059 (-0.14, 0.021) | 0.15 | 630,803\|14,798\|25 |

Figure 13

| Gene | Genetic exposure, variant type; frequency cutoff in % | AAF, fraction of 1 | Beta (95% CI) per allele in SD units of BMI | Beta (95% CI) per allele in kg/m2 units of BMI | p | Genotype counts, RR\|RA\|AA genotypes |
|---|---|---|---|---|---|---|
| GPR75-ASB3 | pLOF; AAF < 1% | 0.00015 | -0.039 (-0.17, 0.088) | -0.21 (-0.89, 0.47) | 0.55 | 645,426\|200\|0 |
| GPR75-ASB3 | pLOF plus any missense; AAF < 0.1% | 0.00497 | -0.0096 (-0.032, 0.013) | -0.052 (-0.17, 0.071) | 0.41 | 639,208\|6,416\|2 |
| GPR75-ASB3 | pLOF plus any missense; AAF < 1% | 0.01565 | -0.0012 (-0.014, 0.012) | -0.0065 (-0.076, 0.063) | 0.85 | 625,469\|20,110\|47 |
| GPR75-ASB3 | pLOF plus deleterious missense (5/5); AAF < 0.1% | 0.00015 | -0.039 (-0.17, 0.088) | -0.21 (-0.89, 0.47) | 0.55 | 645,426\|200\|0 |
| GPR75-ASB3 | pLOF plus deleterious missense (5/5); AAF < 1% | 0.00015 | -0.039 (-0.17, 0.088) | -0.21 (-0.89, 0.47) | 0.55 | 645,426\|200\|0 |
| GPR75-ASB3 | pLOF plus deleterious missense (1/5); AAF < 0.1% | 0.00385 | -0.02 (-0.046, 0.0056) | -0.11 (-0.25, 0.03) | 0.13 | 640,655\|4,969\|2 |
| GPR75-ASB3 | pLOF plus deleterious missense (1/5); AAF < 1% | 0.01319 | -0.0045 (-0.019, 0.0096) | -0.024 (-0.1, 0.052) | 0.53 | 628,634\|16,956\|36 |

Figure 13 (cont.)

| Genetic exposure, variant type; frequency cutoff in % | Additional covariates adjusted for in the analysis in addition to standard covariates* | Beta (95% CI) per allele in SD units of BMI | Beta (95% CI) per allele in kg/m² units of BMI | p | AAF, fraction of 1 | Genotype counts, RR\|RA\|AA genotypes |
|---|---|---|---|---|---|---|
| GPR75 pLOF; AAF < 1% | ASB3 pLOF (AAF < 1%); ASB3 pLOF plus any missense (AAF < 0.1%); ASB3 pLOF plus any missense (AAF < 1%); ASB3 pLOF plus deleterious missense (5/5) (AAF < 0.1%); ASB3 pLOF plus deleterious missense (5/5) (AAF < 1%); ASB3 pLOF plus deleterious missense (1/5) (AAF < 0.1%); ASB3 pLOF plus deleterious missense (1/5) (AAF < 1%); GPR75-ASB3 pLOF (AAF < 1%); GPR75-ASB3 pLOF plus any missense (AAF < 0.1%); GPR75-ASB3 pLOF plus any missense (AAF < 1%); GPR75-ASB3 pLOF plus deleterious missense (5/5) (AAF < 0.1%); GPR75-ASB3 pLOF plus deleterious missense (5/5) (AAF < 1%); GPR75-ASB3 pLOF plus deleterious missense (1/5) (AAF < 0.1%); GPR75-ASB3 pLOF plus deleterious missense (1/5) (AAF < 1%) | -0.34 (-0.46, -0.22) | -1.85 (-2.50, -1.19) | 3.1E-08 | 0.00018 | 645,398\|228\|0 |
| GPR75 pLOF; AAF < 1% | 26 common variants associated with BMI at the locus in Europeans (listed in Table S9) | -0.34 (-0.46, -0.22) | -1.85 (-2.50, -1.19) | 3.1E-08 | 0.00018 | 645,398\|228\|0 |

Figure 14

| Variant (CPRA) | dbSNP rsID | AAF | PPA | Sentinel variant in credible set | Nearest gene |
|---|---|---|---|---|---|
| 2:53634252:A:G | rs59428052 | 0.147 | 0.304 | Yes | ASB3,GPR75-ASB3 |
| 2:53899622:C:A | rs805422 | 0.431 | 0.063 | No | PSME4 |
| 2:53966056:T:C | rs805343 | 0.524 | 0.047 | No | PSME4 |
| 2:53965962:A:G | rs805342 | 0.523 | 0.046 | No | PSME4 |
| 2:53893683:G:A | rs805412 | 0.415 | 0.045 | No | PSME4 |
| 2:53812428:C:G | rs2287347 | 0.092 | 0.039 | No | ERLEC1,GPR75-ASB3 |
| 2:53813267:A:G | rs6545368 | 0.092 | 0.026 | No | ERLEC1,GPR75-ASB3 |
| 2:53965020:G:A | rs805341 | 0.522 | 0.024 | No | PSME4 |
| 2:53921194:C:A | rs805330 | 0.431 | 0.022 | No | PSME4 |
| 2:53807744:G:T | rs6724214 | 0.092 | 0.021 | No | ERLEC1,GPR75-ASB3 |
| 2:53938709:G:T | rs805361 | 0.438 | 0.02 | No | PSME4 |
| 2:53934885:C:T | rs805358 | 0.439 | 0.015 | No | PSME4 |
| 2:53907915:C:T | rs805318 | 0.44 | 0.01 | No | PSME4 |
| 2:54051530:T:C | rs7590846 | 0.374 | 0.007 | No | ACYP2 |
| 2:54051448:C:G | rs1559037 | 0.373 | 0.006 | No | ACYP2 |
| 2:54052186:A:G | rs1833497 | 0.375 | 0.005 | No | ACYP2 |
| 2:54052992:A:C | rs1862122 | 0.375 | 0.005 | No | ACYP2 |
| 2:53899904:C:T | rs805423 | 0.482 | 0.005 | No | PSME4 |
| 2:53995028:C:A | rs7591431 | 0.361 | 0.004 | No | ACYP2 |
| 2:53958004:A:G | rs805335 | 0.49 | 0.004 | No | PSME4 |
| 2:54053847:A:G | rs7558126 | 0.374 | 0.004 | No | ACYP2 |
| 2:53733092:C:T | rs114272138 | 0.022 | 0.003 | No | ASB3,GPR75-ASB3 |
| 2:53822332:G:A | rs3095756 | 0.412 | 0.002 | No | GPR75-ASB3 |
| 2:53720820:C:A | rs77601694 | 0.022 | 0.002 | No | ASB3,GPR75-ASB3 |
| 2:53822111:G:A | rs2542577 | 0.412 | 0.002 | No | GPR75-ASB3 |
| 2:53821221:G:A | rs2542575 | 0.412 | 0.002 | No | GPR75-ASB3 |

Figure 15

| Variant (CPRA) | Annotation | Nonsynonymous variants in LD (R^2 > 0.8) | R^2 with nonsynonymous variant |
|---|---|---|---|
| 2:53634252:A:G | intergenic | None | |
| 2:53899622:C:A | intronic | None | |
| 2:53966056:T:C | intronic | None | |
| 2:53965962:A:G | intronic | None | |
| 2:53893683:G:A | synonymous | None | |
| 2:53812428:C:G | intronic;intronic | None | |
| 2:53813267:A:G | intronic;intronic | None | |
| 2:53965020:G:A | intronic | None | |
| 2:53921194:C:A | intronic | None | |
| 2:53807744:G:T | intronic | None | |
| 2:53938709:G:T | intronic | None | |
| 2:53934885:C:T | intronic | None | |
| 2:53907915:C:T | intronic | None | |
| 2:54051530:T:C | intronic | None | |
| 2:54051448:C:G | intronic | None | |
| 2:54052186:A:G | intronic | None | |
| 2:54052992:A:C | intronic | None | |
| 2:53899904:C:T | synonymous | None | |
| 2:53995028:C:A | intronic | None | |
| 2:53958004:A:G | intronic | None | |
| 2:54053847:A:G | intronic | None | |
| 2:53733092:C:T | intronic | 2:53765485:G:C,2:53765485:G:C | 0.83,0.83 |
| 2:53822332:G:A | intergenic | None | |
| 2:53720820:C:A | intronic;intronic | 2:53765485:G:C,2:53765485:G:C | 0.83,0.83 |
| 2:53822111:G:A | intergenic | None | |
| 2:53821221:G:A | intergenic | None | |

Figure 15 (cont.)

| Variant (CPRA) | Nonsynonymous variant effect | Gene for nonsynonymous change | Sentinel eQTL in LD (R^2 > 0.8) |
|---|---|---|---|
| 2:53634252:A:G | | | None |
| 2:53899622:C:A | | | None |
| 2:53966056:T:C | | | None |
| 2:53965962:A:G | | | None |
| 2:53893683:G:A | | | None |
| 2:53812428:C:G | | | None |
| 2:53813267:A:G | | | None |
| 2:53965020:G:A | | | None |
| 2:53921194:C:A | | | None |
| 2:53807744:G:T | | | None |
| 2:53938709:G:T | | | None |
| 2:53934885:C:T | | | None |
| 2:53907915:C:T | | | None |
| 2:54051530:T:C | | | None |
| 2:54051448:C:G | | | None |
| 2:54052186:A:G | | | None |
| 2:54052992:A:C | | | None |
| 2:53899904:C:T | | | None |
| 2:53995028:C:A | | | None |
| 2:53958004:A:G | | | None |
| 2:54053847:A:G | | | None |
| 2:53733092:C:T | missense,missense | ASB3,GPR75-ASB3 | None |
| 2:53822332:G:A | | | None |
| 2:53720820:C:A | missense,missense | ASB3,GPR75-ASB3 | None |
| 2:53822111:G:A | | | None |
| 2:53821221:G:A | | | None |

Figure 15 (cont.)

| Exposure | Excluded genetic variants | Number of genetic variants left in the analysis | Beta (95% CI) per allele in SD units of BMI | p |
|---|---|---|---|---|
| GPR75 pLOF genetic variants with AAF < 1% | None (main analysis as reported in Table 1) | 46 | -0.34 (-0.46, -0.22) | 2.6E-08 |
| | 2:53853134:T:G | 45 | -0.34 (-0.46, -0.22) | 2.5E-08 |
| | 2:53853135:T:G | 45 | -0.33 (-0.45, -0.22) | 3.9E-08 |
| | 2:53853136:A:C | 45 | -0.34 (-0.45, -0.22) | 3.9E-08 |
| | 2:53853200:GGT:G | 45 | -0.34 (-0.46, -0.22) | 3.0E-08 |
| | 2:53853245:GT:G | 45 | -0.34 (-0.46, -0.22) | 2.7E-08 |
| | 2:53853256:G:A | 45 | -0.33 (-0.45, -0.22) | 3.9E-08 |
| | 2:53853352:G:A | 45 | -0.36 (-0.49, -0.24) | 4.9E-09 |
| | 2:53853354:CCA:C | 45 | -0.36 (-0.48, -0.24) | 8.1E-09 |
| | 2:53853382:TG:T | 45 | -0.35 (-0.48, -0.23) | 3.6E-08 |
| | 2:53853502:T:A | 45 | -0.33 (-0.45, -0.21) | 7.0E-08 |
| | 2:53853535:G:A | 45 | -0.34 (-0.47, -0.22) | 5.5E-08 |
| | 2:53853547:T:A | 45 | -0.33 (-0.45, -0.21) | 8.4E-08 |
| | 2:53853560:G:GA | 45 | -0.33 (-0.45, -0.21) | 6.2E-08 |

Figure 17

| Exposure | Excluded genetic variants | Number of genetic variants left in the analysis | Beta (95% CI) per allele in SD units of BMI | p |
|---|---|---|---|---|
| GPR75 pLOF genetic variants with AAF < 1% | 2:53853641:GTT:G | 45 | -0.34 (-0.46, -0.22) | 2.8E-08 |
| | 2:53853680:CAATTCAAACTGGT:C | 45 | -0.34 (-0.46, -0.22) | 2.4E-08 |
| | 2:53853692:G:T | 45 | -0.34 (-0.46, -0.22) | 1.9E-08 |
| | 2:53853730:G:A | 45 | -0.34 (-0.46, -0.22) | 2.3E-08 |
| | 2:53853771:G:C | 45 | -0.34 (-0.46, -0.22) | 2.2E-08 |
| | 2:53853853:G:A | 45 | -0.34 (-0.46, -0.22) | 2.2E-08 |
| | 2:53853877:G:A | 45 | -0.33 (-0.45, -0.21) | 1.2E-07 |
| | 2:53853926:G:T | 45 | -0.33 (-0.45, -0.21) | 5.9E-08 |
| | 2:53853927:T:TA | 45 | -0.34 (-0.46, -0.22) | 3.0E-08 |
| | 2:53853946:G:GT | 45 | -0.33 (-0.45, -0.21) | 5.4E-08 |
| | 2:53853967:TGG:T | 45 | -0.34 (-0.46, -0.22) | 1.9E-08 |
| | 2:53854009:G:A | 45 | -0.34 (-0.46, -0.22) | 2.1E-08 |
| | 2:53854037:A:AG | 45 | -0.33 (-0.45, -0.21) | 4.6E-08 |
| | 2:53854045:ACTTT:A | 45 | -0.34 (-0.46, -0.21) | 1.0E-07 |

Figure 17 (cont.)

| Exposure | Excluded genetic variants | Number of genetic variants left in the analysis | Beta (95% CI) per allele in SD units of BMI | p |
|---|---|---|---|---|
| GPR75 pLOF genetic variants with AAF < 1% | 2:53854051:T:A | 45 | -0.33 (-0.45, -0.21) | 8.5E-08 |
| | 2:53854057:G:A | 45 | -0.34 (-0.47, -0.2) | 4.7E-07 |
| | 2:53854078:G:A | 45 | -0.34 (-0.46, -0.22) | 1.7E-08 |
| | 2:53854099:CAG:C | 45 | -0.33 (-0.45, -0.21) | 8.9E-08 |
| | 2:53854135:CAT:C | 45 | -0.34 (-0.46, -0.22) | 3.0E-08 |
| | 2:53854137:TAGAG:T | 45 | -0.34 (-0.46, -0.22) | 3.3E-08 |
| | 2:53854306:G:A | 45 | -0.34 (-0.46, -0.22) | 3.1E-08 |
| | 2:53854380:G:C | 45 | -0.34 (-0.46, -0.22) | 2.3E-08 |
| | 2:53854409:A:AG | 45 | -0.34 (-0.46, -0.22) | 2.7E-08 |
| | 2:53854421:ACTACTGG:A | 45 | -0.31 (-0.43, -0.19) | 7.2E-07 |
| | 2:53854474:C:A | 45 | -0.34 (-0.46, -0.22) | 1.8E-08 |
| | 2:53854476:C:CA | 45 | -0.34 (-0.46, -0.23) | 1.4E-08 |
| | 2:53854485:AG:A | 45 | -0.34 (-0.46, -0.22) | 2.3E-08 |
| | 2:53854644:TG:T | 45 | -0.34 (-0.46, -0.21) | 5.6E-08 |
| | 2:53854685:TC:T | 45 | -0.34 (-0.45, -0.22) | 3.5E-08 |

Figure 17 (cont.)

| Exposure | Excluded genetic variants | Number of genetic variants left in the analysis | Beta (95% CI) per allele in SD units of BMI | p |
|---|---|---|---|---|
| GPR75 pLOF genetic variants with AAF < 1% | 2:53854695:G:T | 45 | -0.34 (-0.46, -0.22) | 2.3E-08 |
| | 2:53854740:TG:T | 45 | -0.34 (-0.46, -0.22) | 2.6E-08 |
| | 2:53854755:A:G | 45 | -0.34 (-0.46, -0.22) | 2.1E-08 |
| | 2:53859827:C:T | 45 | -0.33 (-0.45, -0.21) | 4.9E-08 |
| | 5 variants associated with body mass index (Ala110fs, Ser219fs, Gln234*, Cys400fs, Lys404*) | 41 | -0.26 (-0.39, -0.12) | 2.2E-04 |

Figure 17 (cont.)

| Gene | Genetic exposure, variant type | Description | AAF, fraction of 1 | Beta (95% CI) per allele in SD units of BMI | p |
|---|---|---|---|---|---|
| 2:53853547:T:A; GPR75 Lys404* | 404* allele | Single variant exome analysis (AAF<1%) | 1.0E-05 | -1.77 (-3.12, -0.43) | 9.5E-03 |
| 2:53853560:G:GA; GPR75 Cys400fs | 400fs allele | Single variant exome analysis (AAF<1%) | 1.2E-06 | -2.25 (-4.04, -0.47) | 1.3E-02 |
| 2:53854057:G:A; GPR75 Gln234* | 234* allele | Single variant exome analysis (AAF<1%) | 2.9E-05 | -0.35 (-0.64, -0.06) | 1.8E-02 |
| 2:53854099:CAG:C; GPR75 Ser219fs | 219fs allele | Single variant exome analysis (AAF<1%) | 3.5E-06 | -1.16 (-2.19, -0.13) | 2.8E-02 |
| 2:53854421:ACTACTGG:A; GPR75 Ala110fs | 110fs allele | Single variant exome analysis (AAF<1%) | 1.2E-05 | -0.99 (-1.55, -0.42) | 6.2E-04 |

Figure 18

D)
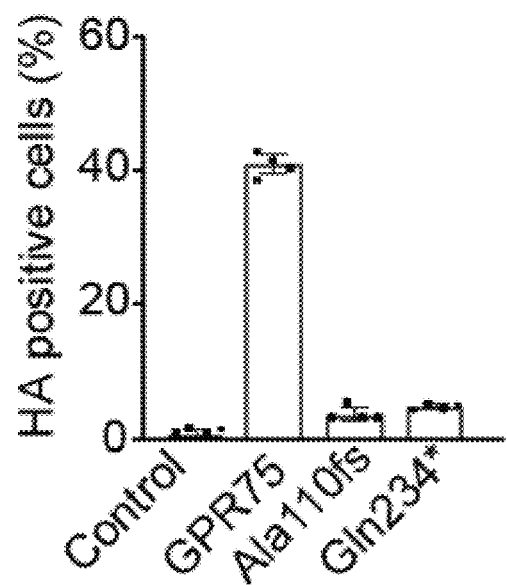
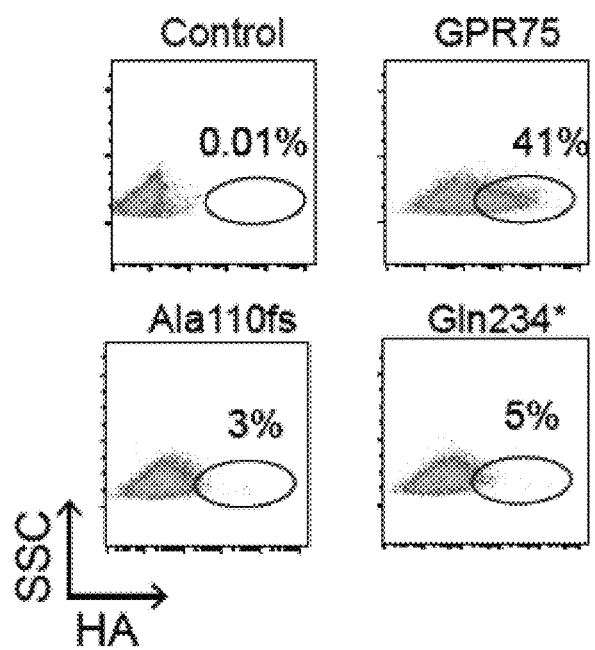
Figure 19 (cont.)

| Exposure | Number of variant sites | Beta (95% CI) per allele in SD units of BMI | p | AAF, fraction of 1 | Genotype counts, RR\|RA\|AA genotypes | Beta (95% CI) per allele in kg/m² units of BMI |
|---|---|---|---|---|---|---|
| N-terminal variants – truncation *before* last intracellular domain | 32 | -0.38 (-0.53, -0.23) | 4.1E-07 | 0.00012 | 645,477\|149\|0 | -2.1 (-2.9, -1.3) |
| C-terminal variants – truncation *within* last intracellular domain | 14 | -0.26 (-0.46, -0.06) | 0.012 | 0.00006 | 645,547\|79\|0 | -1.4 (-2.5, -0.3) |
| N-terminal variants – truncation *before* last 100 amino acids | 37 | -0.4 (-0.54, -0.26) | 6.4E-09 | 0.00014 | 645,450\|176\|0 | -2.2 (-2.9, -1.4) |
| C-terminal variants – truncation *within* last 100 amino acids | 9 | -0.13 (-0.38, 0.12) | 0.32 | 0.00004 | 645,574\|52\|0 | -0.7 (-2.1, 0.7) |

Figure 20

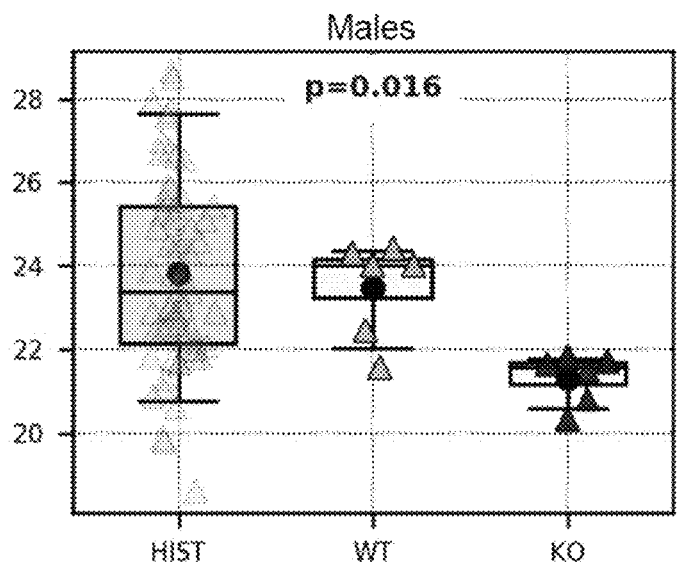
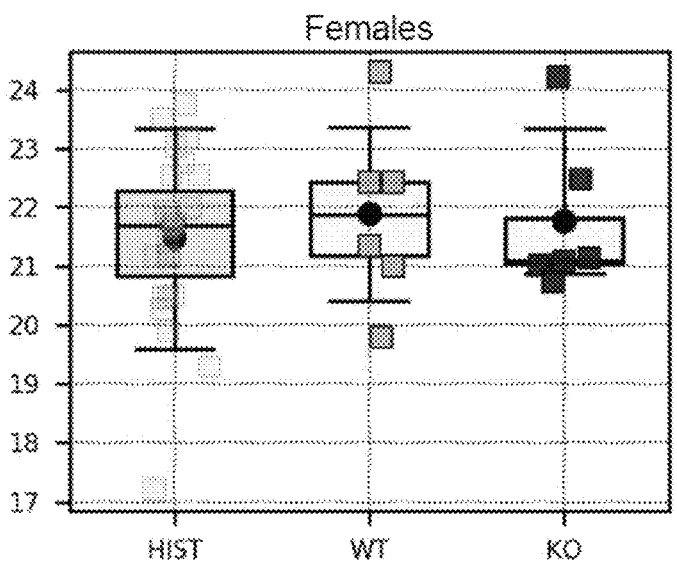
Figure 21

A)
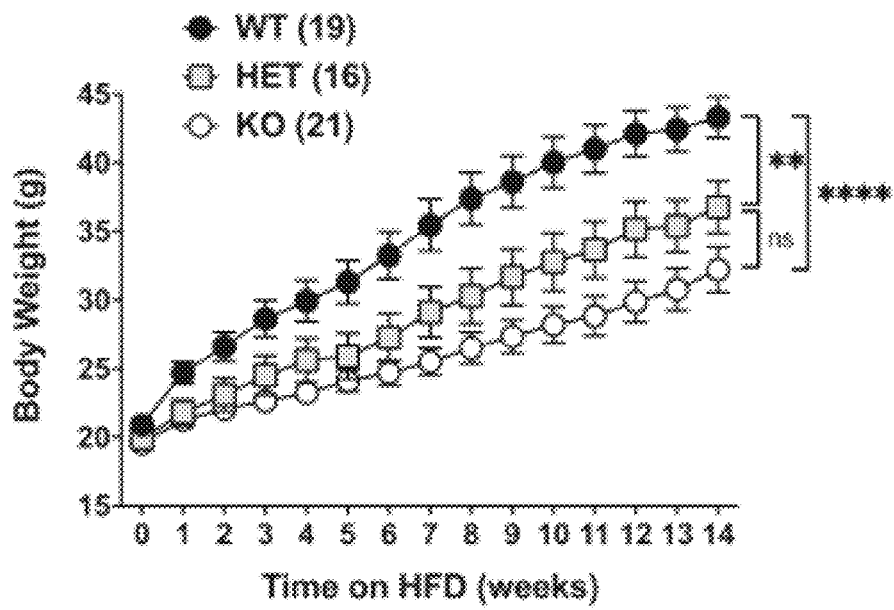
B)
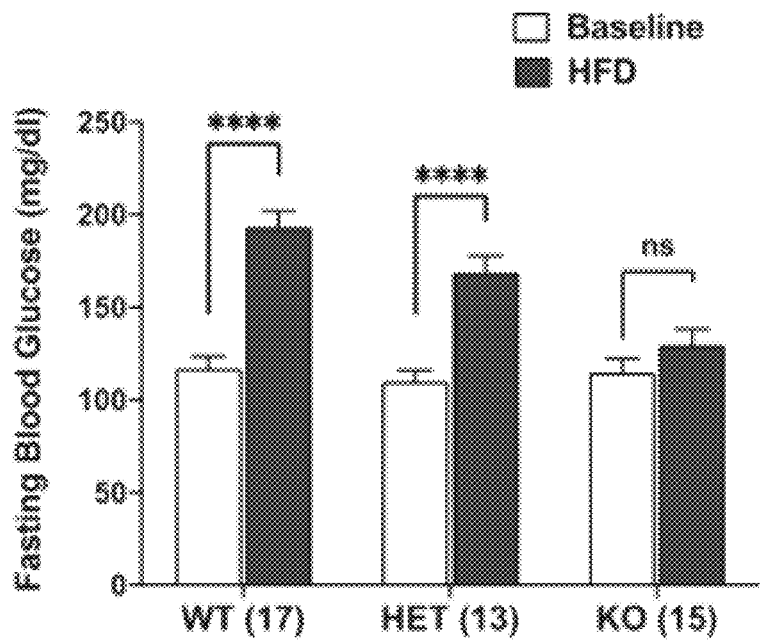
Figure 24

C)
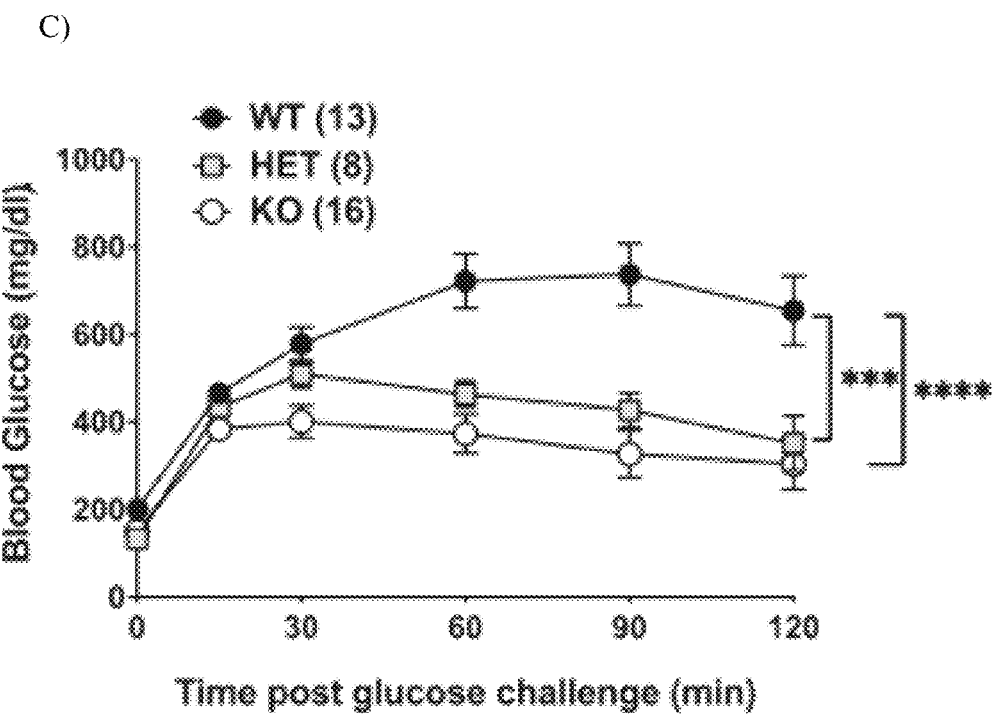
D)
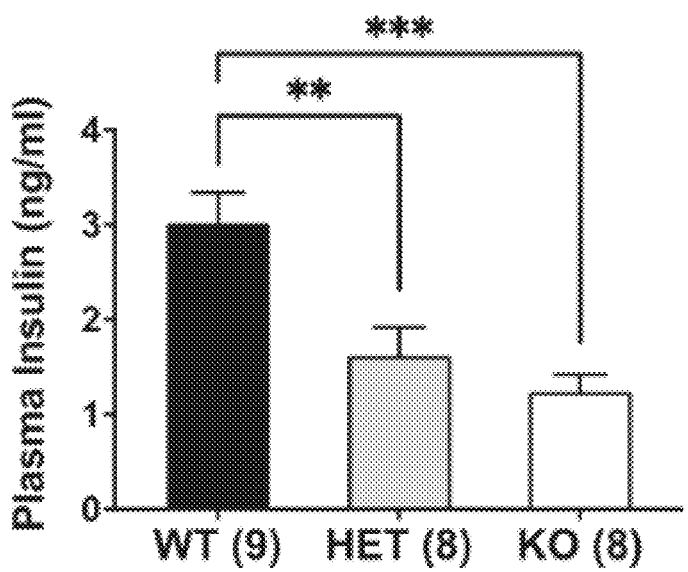
Figure 24 (cont.)

A)
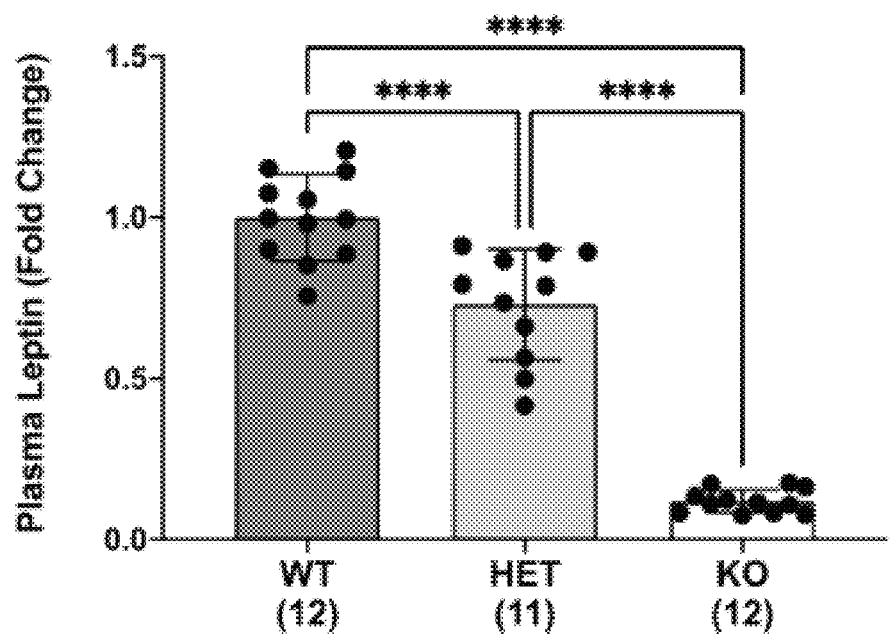
B)
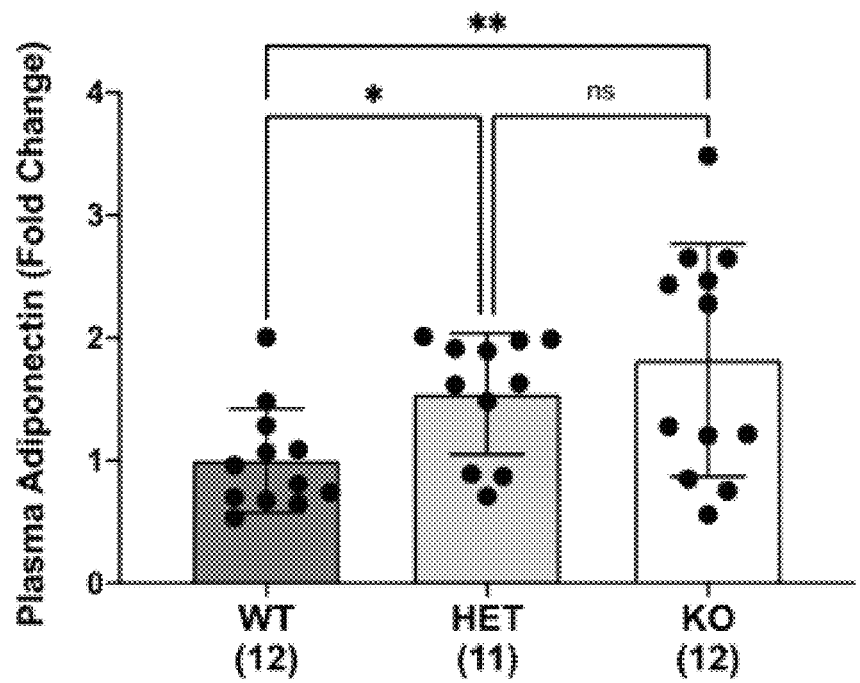
Figure 25

C)

TREATMENT OF OBESITY WITH G-PROTEIN COUPLED RECEPTOR 75 (GPR75) INHIBITORS

REFERENCE TO SEQUENCE LISTING

This application includes a Sequence Listing submitted electronically as a text file named 18923804801SEQ, created on Jun. 20, 2021, with a size of 533 kilobytes. The Sequence Listing is incorporated herein by reference.

FIELD

The present disclosure relates generally to the treatment of subjects having obesity with G-Protein Coupled Receptor 75 (GPR75) inhibitors, methods of identifying subjects having an increased risk of developing obesity, methods of detecting GPR75 variant nucleic acid molecules and variant polypeptides, and GPR75 variant nucleic acid molecules and GPR75 variant polypeptides.

BACKGROUND

Obesity and its cardio-metabolic complications, in particular type 2 diabetes and coronary artery disease, account for significant morbidity and mortality globally. There is a substantial unmet medical need for safe and effective weight loss approaches.

Lifestyle interventions on diet and physical activity are the first option for the management of obesity and overweight, but efficacy can be limited, and weight regain is common. Bariatric surgery can be highly effective for weight loss in severely obese or high-risk patients, but its use is limited by its invasive nature, cost, risk of perioperative adverse events including perioperative death. While a few drugs have demonstrated efficacy in weight-reduction, pharmacotherapy for the treatment of obesity is limited by the modest weight loss induced by most drugs, side effect profile of some agents, contraindications, low compliance, and barriers to treatment including underprescription.

GPR75 is a member of the G protein-coupled receptor family. GPRs are cell surface receptors that activate guanine-nucleotide binding proteins upon the binding of a ligand. GPR75 is activated by the chemokine CCL5/RANTES. GPR75 is likely coupled to heterotrimeric Gq proteins, and stimulates inositol trisphosphate production and calcium mobilization upon activation. Together with CCL5/RANTES, GPR75 may play a role in neuron survival through activation of a downstream signaling pathway involving the PI3, Akt and MAP kinases. CCL5/RANTES may also regulate insulin secretion by pancreatic islet cells through activation of this receptor.

SUMMARY

The present disclosure provides methods of treating a subject having obesity, the method comprising administering a G-Protein Coupled Receptor 75 (GPR75) inhibitor to the subject. In some embodiments, the subject is GPR75 reference or is heterozygous for a GPR75 missense variant nucleic acid molecule encoding a predicted loss-of-function GPR75 polypeptide.

The present disclosure also provides methods of treating a subject having excessive weight, the method comprising administering a GPR75 inhibitor to the subject. In some embodiments, the subject is GPR75 reference or is heterozygous for a GPR75 missense variant nucleic acid molecule encoding a predicted loss-of-function GPR75 polypeptide.

The present disclosure also provides methods of treating a subject having elevated BMI, the method comprising administering a GPR75 inhibitor to the subject. In some embodiments, the subject is GPR75 reference or is heterozygous for a GPR75 missense variant nucleic acid molecule encoding a predicted loss-of-function GPR75 polypeptide.

The present disclosure also provides methods of treating a subject having elevated body fat mass, percentage, or volume, the method comprising administering a GPR75 inhibitor to the subject. In some embodiments, the subject is GPR75 reference or is heterozygous for a GPR75 missense variant nucleic acid molecule encoding a predicted loss-of-function GPR75 polypeptide.

The present disclosure also provides methods of treating a subject having excessive food intake, the method comprising administering a GPR75 inhibitor to the subject. In some embodiments, the subject is GPR75 reference or is heterozygous for a GPR75 missense variant nucleic acid molecule encoding a predicted loss-of-function GPR75 polypeptide.

The present disclosure also provides methods of treating a subject to prevent weight gain or to maintain weight loss, the method comprising administering a GPR75 inhibitor to the subject. In some embodiments, the subject is GPR75 reference or is heterozygous for a GPR75 missense variant nucleic acid molecule encoding a predicted loss-of-function GPR75 polypeptide.

The present disclosure also provides methods of treating a subject with a therapeutic agent that treats or inhibits obesity, wherein the subject is obese, the method comprising the steps of: determining whether the subject has a GPR75 missense variant nucleic acid molecule encoding a predicted loss-of-function GPR75 polypeptide by: obtaining or having obtained a biological sample from the subject; and performing or having performed a sequence analysis on the biological sample to determine if the subject has a genotype comprising the GPR75 missense variant nucleic acid molecule; and administering or continuing to administer the therapeutic agent that treats or inhibits obesity and/or a GPR75 inhibitor in a standard dosage amount to a subject that is GPR75 reference; and administering or continuing to administer the therapeutic agent that treats or inhibits obesity and/or a GPR75 inhibitor in an amount that is the same as or lower than a standard dosage amount to a subject that is heterozygous for a GPR75 missense variant nucleic acid molecule; wherein the presence of a genotype having the GPR75 missense variant nucleic acid molecule encoding a predicted loss-of-function GPR75 polypeptide indicates the subject has a reduced risk of developing obesity.

The present disclosure also provides methods of identifying a subject having an increased risk for developing obesity, wherein the method comprises: determining or having determined the presence or absence of a GPR75 missense variant nucleic acid molecule encoding a predicted loss-of-function GPR75 polypeptide in a biological sample obtained from the subject; wherein: when the subject is GPR75 reference, then the subject has an increased risk for developing obesity; and when the subject is heterozygous or homozygous for a GPR75 missense variant nucleic acid molecule, then the subject has a decreased risk for developing obesity.

The present disclosure also provides methods of detecting a human GPR75 variant nucleic acid molecule in a subject comprising assaying a sample obtained from the subject to determine whether a nucleic acid molecule in the sample is:

a genomic nucleic acid molecule comprising a nucleotide sequence: lacking a CCAGTAG heptanucleotide at positions corresponding to positions 5,540-5,546 according to SEQ ID NO:1, or the complement thereof; comprising an adenine at a position corresponding to position 5,557 according to SEQ ID NO:3, or the complement thereof; comprising a thymine at a position corresponding to position 5,911 according to SEQ ID NO:4, or the complement thereof; lacking an AAAG tetranucleotide at positions corresponding to positions 5,920-5,923 according to SEQ ID NO:1, or the complement thereof; comprising an insertion of a thymine at a position corresponding to position 6,411 according to SEQ ID NO:6, or the complement thereof; or comprising a guanine at a position corresponding to position 5,831 according to SEQ ID NO:99, or the complement thereof; an mRNA molecule having a nucleotide sequence: lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; lacking a CCAGUAG heptanucleotide at positions corresponding to positions 600-606 according to SEQ ID NO:10, or the complement thereof; comprising an adenine at a position corresponding to position 556 according to SEQ ID NO:12, or the complement thereof; comprising an adenine at a position corresponding to position 457 according to SEQ ID NO:17, or the complement thereof; comprising an adenine at a position corresponding to position 378 according to SEQ ID NO:22, or the complement thereof; comprising an adenine at a position corresponding to position 617 according to SEQ ID NO:27, or the complement thereof; comprising a uracil at a position corresponding to position 910 according to SEQ ID NO:13, or the complement thereof; comprising a uracil at a position corresponding to position 811 according to SEQ ID NO:18, or the complement thereof; comprising a uracil at a position corresponding to position 732 according to SEQ ID NO:23, or the complement thereof; comprising a uracil at a position corresponding to position 971 according to SEQ ID NO:28, or the complement thereof; lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; lacking an AAAG tetranucleotide at positions corresponding to positions 980-983 according to SEQ ID NO:10, or the complement thereof; comprising an insertion of a uracil at a position corresponding to position 1,410 according to SEQ ID NO:15, or the complement thereof; comprising an insertion of a uracil at a position corresponding to position 1,311 according to SEQ ID NO:20, or the complement thereof; comprising an insertion of a uracil at a position corresponding to position 1,232 according to SEQ ID NO:25, or the complement thereof; comprising an insertion of a uracil at a position corresponding to position 1,471 according to SEQ ID NO:30, or the complement thereof; comprising a guanine at a position corresponding to position 830 according to SEQ ID NO:100, or the complement thereof; comprising a guanine at a position corresponding to position 731 according to SEQ ID NO:101, or the complement thereof; comprising a guanine at a position corresponding to position 652 according to SEQ ID NO:102, or the complement thereof; or comprising a guanine at a position corresponding to position 891 according to SEQ ID NO:103, or the complement thereof; or a cDNA molecule produced from an mRNA molecule, wherein the cDNA molecule has a nucleotide sequence: lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; lacking a CCAGTAG heptanucleotide at positions corresponding to positions 600-606 according to SEQ ID NO:34, or the complement thereof; comprising an adenine at a position corresponding to position 556 according to SEQ ID NO:36, or the complement thereof; comprising an adenine at a position corresponding to position 457 according to SEQ ID NO:41, or the complement thereof; comprising an adenine at a position corresponding to position 378 according to SEQ ID NO:46, or the complement thereof; comprising an adenine at a position corresponding to position 617 according to SEQ ID NO:51, or the complement thereof; comprising a thymine at a position corresponding to position 910 according to SEQ ID NO:37, or the complement thereof; comprising a thymine at a position corresponding to position 811 according to SEQ ID NO:42, or the complement thereof; comprising a thymine at a position corresponding to position 732 according to SEQ ID NO:47, or the complement thereof; comprising a thymine at a position corresponding to position 971 according to SEQ ID NO:52, or the complement thereof; lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; lacking an AAAG tetranucleotide at positions corresponding to positions 980-983 according to SEQ ID NO:34, or the complement thereof; comprising an insertion of a thymine at a position corresponding to position 1,410 according to SEQ ID NO:39, or the complement thereof; comprising an insertion of a thymine at a position corresponding to position 1,311 according to SEQ ID NO:44, or the complement thereof; comprising an insertion of a thymine at a position corresponding to position 1,232 according to SEQ ID NO:49, or the complement thereof; comprising an insertion of a thymine at a position corresponding to position 1,471 according to SEQ ID NO:54, or the complement thereof; comprising a guanine at a position corresponding to position 830 according to SEQ ID NO:104, or the complement thereof; comprising a guanine at a position corresponding to position 731 according to SEQ ID NO:105, or the complement thereof; comprising a guanine at a position corresponding to position 652 according to SEQ ID NO:106, or the complement thereof; or comprising a guanine at a position corresponding to position 891 according to SEQ ID NO:107, or the complement thereof.

The present disclosure also provides methods of detecting the presence of a human GPR75 Ala110fs, Ala116Thr, Tyr207Cys, Gln234Stop, Arg236fs, or Cys400fs variant polypeptide, comprising performing an assay on a sample obtained from a subject to determine whether a GPR75 protein in the sample comprises SEQ ID NO:56, SEQ ID NO:57, SEQ ID NO:58, SEQ ID NO:59, SEQ ID NO:60, or SEQ ID NO:108.

The present disclosure also provides isolated alteration-specific probes or alteration-specific primers comprising at least about 15 nucleotides, wherein the alteration-specific probe or alteration-specific primer comprises a nucleotide sequence which is complementary to a portion of a nucleotide sequence encoding a human GPR75 polypeptide, wherein the portion comprises a position corresponding to: positions 5,540-5,546 according to SEQ ID NO:2, or the complement thereof; positions 539-545 according to SEQ ID NO:11, or the complement thereof; positions 440-446 according to SEQ ID NO:16, or the complement thereof; positions 361-367 according to SEQ ID NO:21, or the complement thereof; positions 600-606 according to SEQ ID NO:26, or the complement thereof; positions 539-545 according to SEQ ID NO:35, or the complement thereof; positions 440-446 according to SEQ ID NO:40, or the complement thereof; positions 361-367 according to SEQ ID NO:45, or the complement thereof; or positions 600-606 according to SEQ ID NO:50, or the complement thereof; positions 5,920-5,923 according to SEQ ID NO:5, or the complement thereof; position 919-922 according to SEQ ID NO:14, or the complement thereof; positions 820-823 according to SEQ ID NO:19, or the complement thereof; positions 741-744 according to SEQ ID NO:24, or the complement thereof; position 980-983 according to SEQ ID NO:29, or the complement thereof; position 919-922 according to SEQ ID NO:38, or the complement thereof; positions 820-823 according to SEQ ID NO:43, or the complement thereof; positions 741-744 according to SEQ ID NO:48, or the complement thereof; or position 980-983 according to SEQ ID NO:53, or the complement thereof; or position 6,411 according to SEQ ID NO:6, or the complement thereof; position 1,410 according to SEQ ID NO:15, or the complement thereof; position 1,311 according to SEQ ID NO:20, or the complement thereof; position 1,232 according to SEQ ID NO:25, or the complement thereof; position 1,471 according to SEQ ID NO:30, or the complement thereof; position 1,410 according to SEQ ID NO:39, or the complement thereof; position 1,311 according to SEQ ID NO:44, or the complement thereof; position 1,232 according to SEQ ID NO:49, or the complement thereof; or position 1,471 according to SEQ ID NO:54, or the complement thereof; position 5,831 according to SEQ ID NO:61, or the complement thereof; position 830 according to SEQ ID NO:100, or the complement thereof; position 731 according to SEQ ID NO:101, or the complement thereof; position 652 according to SEQ ID NO:102, or the complement thereof; position 891 according to SEQ ID NO:103, or the complement thereof; position 830 according to SEQ ID NO:104, or the complement thereof; position 731 according to SEQ ID NO:105, or the complement thereof; position 652 according to SEQ ID NO:106, or the complement thereof; or position 891 according to SEQ ID NO:107, or the complement thereof.

The present disclosure also provides molecular complexes comprising an alteration-specific primer or an alteration-specific probe hybridized to a genomic nucleic acid molecule comprising a nucleotide sequence encoding a human GPR75 polypeptide, wherein the alteration-specific primer or the alteration-specific probe is hybridized to: nucleotides at positions corresponding to positions 5,539-5,540 according to SEQ ID NO:2, or the complement thereof; an adenine at a position corresponding to position 5,557 according to SEQ ID NO:3, or the complement thereof; a thymine at a position corresponding to position 5,911 according to SEQ ID NO:4, or the complement thereof; nucleotides at positions corresponding to positions 5,919-5,920 according to SEQ ID NO:5, or the complement thereof; a thymine at a position corresponding to position 6,411 according to SEQ ID NO:6, or the complement thereof; or a guanine at a position corresponding to position 5,831 according to SEQ ID NO:99, or the complement thereof.

The present disclosure also provides molecular complexes comprising an alteration-specific primer or an alteration-specific probe hybridized to an mRNA molecule comprising a nucleotide sequence encoding a human GPR75 polypeptide, wherein the alteration-specific primer or the alteration-specific probe is hybridized to: nucleotides at positions corresponding to positions 538-539 according to SEQ ID NO:11, or the complement thereof; nucleotides at positions corresponding to positions 439-440 according to SEQ ID NO:16, or the complement thereof; nucleotides at positions corresponding to positions 360-361 according to SEQ ID NO:21, or the complement thereof; nucleotides at positions corresponding to positions 599-600 according to SEQ ID NO:26, or the complement thereof; an adenine at a position corresponding to position 556 according to SEQ ID NO:12, or the complement thereof; an adenine at a position corresponding to position 457 according to SEQ ID NO:17, or the complement thereof; an adenine at a position corresponding to position 378 according to SEQ ID NO:22, or the complement thereof; an adenine at a position corresponding to position 617 according to SEQ ID NO:27, or the complement thereof; a uracil at a position corresponding to position 910 according to SEQ ID NO:13, or the complement thereof; a uracil at a position corresponding to position 811 according to SEQ ID NO:18, or the complement thereof; a uracil at a position corresponding to position 732 according to SEQ ID NO:23, or the complement thereof; a uracil at a position corresponding to position 971 according to SEQ ID NO:28, or the complement thereof; nucleotides at positions corresponding to positions 918-919 according to SEQ ID NO:14, or the complement thereof; nucleotides at positions corresponding to positions 819-820 according to SEQ ID NO:19, or the complement thereof; nucleotides at positions corresponding to positions 740-741 according to SEQ ID NO:24, or the complement thereof; nucleotides at positions corresponding to positions 979-980 according to SEQ ID NO:29, or the complement thereof; a uracil at a position corresponding to position 1,410 according to SEQ ID NO:15, or the complement thereof; a uracil at a position corresponding to position 1,311 according to SEQ ID NO:20, or the complement thereof; a uracil at a position corresponding to position 1,232 according to SEQ ID NO:25, or the complement thereof; a uracil at a position corresponding to position 1,471 according to SEQ ID NO:30, or the complement thereof; a guanine at a position corresponding to position 830 according to SEQ ID NO:100, or the complement thereof; a guanine at a position corresponding to position 731 according to SEQ ID NO:101, or the complement thereof; a guanine at a position corresponding to position 652 according to SEQ ID NO:102, or the complement thereof; or a guanine at a position corresponding to position 891 according to SEQ ID NO:103, or the complement thereof.

The present disclosure also provides molecular complexes comprising an alteration-specific primer or an alteration-specific probe hybridized to a cDNA molecule comprising a nucleotide sequence encoding a human GPR75 polypeptide, wherein the alteration-specific primer or the alteration-specific probe is hybridized to: nucleotides at positions corresponding to positions 538-539 according to SEQ ID NO:35, or the complement thereof; nucleotides at positions corresponding to positions 439-440 according to SEQ ID NO:40, or the complement thereof; nucleotides at positions corresponding to positions 360-361 according to SEQ ID NO:45, or the complement thereof; nucleotides at positions corresponding to positions 599-600 according to SEQ ID NO:50, or the complement thereof; an adenine at a position corresponding to position 556 according to SEQ ID NO:36, or the complement thereof; an adenine at a position corresponding to position 457 according to SEQ ID NO:41, or the complement thereof; an adenine at a position corresponding to position 378 according to SEQ ID NO:46, or the complement thereof; an adenine at a position corresponding to position 617 according to SEQ ID NO:51, or the complement thereof; a thymine at a position corresponding to position 910 according to SEQ ID NO:37, or the complement thereof; a thymine at a position corresponding to position 811 according to SEQ ID NO:42, or the complement thereof; a thymine at a position corresponding to position 732 according to SEQ ID NO:47, or the complement thereof; a thymine at a position corresponding to position 971 according to SEQ ID NO:52, or the complement thereof; nucleotides at positions corresponding to positions 918-919 according to SEQ ID NO:38, or the complement thereof; nucleotides at positions corresponding to positions 819-820 according to SEQ ID NO:43, or the complement thereof; nucleotides at positions corresponding to positions 740-741 according to SEQ ID NO:48, or the complement thereof; nucleotides at positions corresponding to positions 979-980 according to SEQ ID NO:53, or the complement thereof; a thymine at a position corresponding to position 1,410 according to SEQ ID NO:39, or the complement thereof; a thymine at a position corresponding to position 1,311 according to SEQ ID NO:44, or the complement thereof; a thymine at a position corresponding to position 1,232 according to SEQ ID NO:49, or the complement thereof; a thymine at a position corresponding to position 1,471 according to SEQ ID NO:54, or the complement thereof; a guanine at a position corresponding to position 830 according to SEQ ID NO:104, or the complement thereof; a guanine at a position corresponding to position 731 according to SEQ ID NO:105, or the complement thereof; a guanine at a position corresponding to position 652 according to SEQ ID NO:106, or the complement thereof; or a guanine at a position corresponding to position 891 according to SEQ ID NO:107, or the complement thereof.

The present disclosure also provides isolated nucleic acid molecules comprising a nucleotide sequence encoding a human GPR75 polypeptide, or the complement thereof, wherein the polypeptide comprises: a frameshift beginning at a position corresponding to position 110 according to SEQ ID NO:56, a frameshift beginning at a position corresponding to position 236 according to SEQ ID NO:59, or a frameshift beginning at a position corresponding to position 400 according to SEQ ID NO:60.

The present disclosure also provides isolated genomic nucleic acid molecules comprising a nucleotide sequence encoding a human GPR75 polypeptide, wherein the nucleotide sequence: lacks a CCAGTAG heptanucleotide at positions corresponding to positions 5,540-5,546 according to SEQ ID NO:1, or the complement thereof; lacks an AAAG tetranucleotide at positions corresponding to positions 5,920-5,923 according to SEQ ID NO:1, or the complement thereof; or comprises an insertion of a thymine at a position corresponding to position 6,411 according to SEQ ID NO:6, or the complement thereof.

The present disclosure also provides isolated mRNA molecules comprising a nucleotide sequence encoding a human GPR75 polypeptide, wherein the nucleotide sequence: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; or comprises an insertion of a uracil at a position corresponding to position 1,471 according to SEQ ID NO:30, or the complement thereof.

The present disclosure also provides isolated cDNA molecules comprising a nucleotide sequence encoding a human GPR75 polypeptide, wherein the nucleotide sequence: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, or the complement thereof; or comprises an insertion of a thymine at a position corresponding to position 1,471 according to SEQ ID NO:54, or the complement thereof.

The present disclosure also provides isolated human GPR75 polypeptides having an amino acid sequence at least about 90% identical to: SEQ ID NO:56, wherein the polypeptide lacks amino acids at positions corresponding to positions 110 to 540 according to SEQ ID NO:55; SEQ ID NO:59, wherein the polypeptide lacks amino acids at positions corresponding to positions 236 to 540 according to SEQ ID NO:55; or SEQ ID NO:60, wherein the polypeptide lacks amino acids at positions corresponding to positions 400 to 540 according to SEQ ID NO:55.

The present disclosure also provides therapeutic agents that treat or inhibit obesity for use in the treatment of obesity in a subject having: a genomic nucleic acid molecule having a nucleotide sequence encoding a human GPR75 polypeptide, wherein the nucleotide sequence: lacks a CCAGTAG heptanucleotide at positions corresponding to positions 5,540-5,546 according to SEQ ID NO:1, or the complement thereof; comprises an adenine at a position corresponding to position 5,557 according to SEQ ID NO:3, or the complement thereof; comprises a thymine at a position corresponding to position 5,911 according to SEQ ID NO:4, or the complement thereof; lacks an AAAG tetranucleotide at positions corresponding to positions 5,920-5,923 according to SEQ ID NO:1, or the complement thereof; comprises an insertion of a thymine at a position corresponding to position 6,411 according to SEQ ID NO:6, or the complement thereof; or comprises a guanine at a position corresponding to position 5,831 according to SEQ ID NO:99, or the complement thereof; an mRNA molecule having a nucleotide sequence encoding a human GPR75 polypeptide, wherein the nucleotide sequence: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; comprises an adenine at a position corresponding to position 556 according to SEQ ID NO:12, or the complement thereof; comprises an adenine at a position corresponding to position 457 according to SEQ ID NO:17, or the complement thereof; comprises an adenine at a position corresponding to position 378 according to SEQ ID NO:22, or the complement thereof; comprises an adenine at a position corresponding to position 617 according to SEQ ID NO:27, or the complement thereof; comprises a uracil at a position corresponding to position 910 according to SEQ ID NO:13, or the complement thereof; comprises a uracil at a position corresponding to position 811 according to SEQ ID NO:18, or the complement thereof; comprises a uracil at a position corresponding to position 732 according to SEQ ID NO:23, or the complement thereof; comprises a uracil at a position corresponding to position 971 according to SEQ ID NO:28, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; comprises an insertion of a uracil at a position corresponding to position 1,471 according to SEQ ID NO:30, or the complement thereof; comprises a guanine at a position corresponding to position 830 according to SEQ ID NO:100, or the complement thereof; comprises a guanine at a position corresponding to position 731 according to SEQ ID NO:101, or the complement thereof; comprises a guanine at a position corresponding to position 652 according to SEQ ID NO:102, or the complement thereof; or comprises a guanine at a position corresponding to position 891 according to SEQ ID NO:103, or the complement thereof; or a cDNA molecule having a nucleotide sequence encoding a human GPR75 polypeptide, wherein the nucleotide sequence: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; comprises an adenine at a position corresponding to position 556 according to SEQ ID NO:36, or the complement thereof; comprises an adenine at a position corresponding to position 457 according to SEQ ID NO:41, or the complement thereof; comprises an adenine at a position corresponding to position 378 according to SEQ ID NO:46, or the complement thereof; comprises an adenine at a position corresponding to position 617 according to SEQ ID NO:51, or the complement thereof; comprises a thymine at a position corresponding to position 910 according to SEQ ID NO:37, or the complement thereof; comprises a thymine at a position corresponding to position 811 according to SEQ ID NO:42, or the complement thereof; comprises a thymine at a position corresponding to position 732 according to SEQ ID NO:47, or the complement thereof; comprises a thymine at a position corresponding to position 971 according to SEQ ID NO:52, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, or the complement thereof; comprises an insertion of a thymine at a position corresponding to position 1,471 according to SEQ ID NO:54, or the complement thereof; comprises a guanine at a position corresponding to position 830 according to SEQ ID NO:104, or the complement thereof; comprises a guanine at a position corresponding to position 731 according to SEQ ID NO:105, or the complement thereof; comprises a guanine at a position corresponding to position 652 according to SEQ ID NO:106, or the complement thereof; or comprises a guanine at a position corresponding to position 891 according to SEQ ID NO:107, or the complement thereof.

The present disclosure also provides GPR75 inhibitors for use in the treatment of obesity in a subject having: a genomic nucleic acid molecule having a nucleotide sequence encoding a human GPR75 polypeptide, wherein the nucleotide sequence: lacks a CCAGTAG heptanucleotide at positions corresponding to positions 5,540-5,546 according to SEQ ID NO:1, or the complement thereof; comprises an adenine at a position corresponding to position 5,557 according to SEQ ID NO:3, or the complement thereof; comprises a thymine at a position corresponding to position 5,911 according to SEQ ID NO:4, or the complement thereof; lacks an AAAG tetranucleotide at positions corresponding to positions 5,920-5,923 according to SEQ ID NO:1, or the complement thereof; comprises an insertion of a thymine at a position corresponding to position 6,411 according to SEQ ID NO:6, or the complement thereof; or comprises a guanine at a position corresponding to position 5,831 according to SEQ ID NO:99, or the complement thereof; an mRNA molecule having a nucleotide sequence encoding a human GPR75 polypeptide, wherein the nucleotide sequence: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; comprises an adenine at a position corresponding to position 556 according to SEQ ID NO:12, or the complement thereof; comprises an adenine at a position corresponding to position 457 according to SEQ ID NO:17, or the complement thereof; comprises an adenine at a position corresponding to position 378 according to SEQ ID NO:22, or the complement thereof; comprises an adenine at a position corresponding to position 617 according to SEQ ID NO:27, or the complement thereof; comprises a uracil at a position corresponding to position 910 according to SEQ ID NO:13, or the complement thereof; comprises a uracil at a position corresponding to position 811 according to SEQ ID NO:18, or the complement thereof; comprises a uracil at a position corresponding to position 732 according to SEQ ID NO:23, or the complement thereof; comprises a uracil at a position corresponding to position 971 according to SEQ ID NO:28, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; comprises an insertion of a uracil at a position corresponding to position 1,471 according to SEQ ID NO:30, or the complement thereof; comprises a guanine at a position corresponding to position 830 according to SEQ ID NO:100, or the complement thereof; comprises a guanine at a position corresponding to position 731 according to SEQ ID NO:101, or the complement thereof; comprises a guanine at a position corresponding to position 652 according to SEQ ID NO:102, or the complement thereof; or comprises a guanine at a position corresponding to position 891 according to SEQ ID NO:103, or the complement thereof; or a cDNA molecule having a nucleotide sequence encoding a human GPR75 polypeptide, wherein the nucleotide sequence: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; comprises an adenine at a position corresponding to position 556 according to SEQ ID NO:36, or the complement thereof; comprises an adenine at a position corresponding to position 457 according to SEQ ID NO:41, or the complement thereof; comprises an adenine at a position corresponding to position 378 according to SEQ ID NO:46, or the complement thereof; comprises an adenine at a position corresponding to position 617 according to SEQ ID NO:51, or the complement thereof; comprises a thymine at a position corresponding to position 910 according to SEQ ID NO:37, or the complement thereof; comprises a thymine at a position corresponding to position 811 according to SEQ ID NO:42, or the complement thereof; comprises a thymine at a position corresponding to position 732 according to SEQ ID NO:47, or the complement thereof; comprises a thymine at a position corresponding to position 971 according to SEQ ID NO:52, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, or the complement thereof; comprises an insertion of a thymine at a position corresponding to position 1,471 according to SEQ ID NO:54, or the complement thereof; comprises a guanine at a position corresponding to position 830 according to SEQ ID NO:104, or the complement thereof; comprises a guanine at a position corresponding to position 731 according to SEQ ID NO:105, or the complement thereof; comprises a guanine at a position corresponding to position 652 according to SEQ ID NO:106, or the complement thereof; or comprises a guanine at a position corresponding to position 891 according to SEQ ID NO:107, or the complement thereof.

BRIEF DESCRIPTION OF THE DRAWINGS

The accompanying figures, which are incorporated in and constitute a part of this specification, illustrate several features of the present disclosure.

FIG. 1 shows baseline characteristics of individuals included in the exome-wide association study. Abbreviations: UKB, UK Biobank; GHS, Geisinger Health System; MCPS, Mexico City Prospective Study; SD, standard deviation; N, number of participants; WHO, World Health Organization; IQR, interquartile range; kg/m², kilograms per square meter; mg/dL, milligrams per deciliter; mmHg, millimeters of mercury.

FIG. 2 shows association results for GPR75 with body mass index in the UKB, GHS and MCPS cohorts. Abbreviations: CI, confidence intervals; SD, standard deviation; BMI, body mass index; AAF, alternative allele frequency; RR, reference-reference genotype; RA, reference-alternative heterozygous genotype; AA, alternative-alternative homozygous genotype; pLOF, predicted loss of function; UKB, UK Biobank; GHS, Geisinger Health System MyCode study; MCPS, Mexico City Prospective Study.

FIG. 3 shows association of GPR75 with body mass index in the exome-wide gene-burden analysis. The Table reports association statistics for the GPR75 gene for which the gene burden of rare pLOF variants was associated with body mass index at the exome-wide level of statistical significance ($p<3.6\times10^{-7}$). Analyses were performed in 645,626 participants from the UKB, GHS and MCPS studies. Genomic coordinates reflect chromosome and physical position in base pairs according to Genome Reference Consortium Human Build 38. Abbreviations: CI, confidence interval; SD, standard deviation; BMI, body mass index; AAF, alternative allele frequency; RR, reference-reference genotype; RA, reference-alternative heterozygous genotype; AA, alternative-alternative homozygous genotype; pLOF, predicted loss of function; Missense (1/5), missense variant predicted to be deleterious by at least 1 out of 5 in silico prediction algorithms; Missense (5/5), missense variant predicted to be deleterious by 5 out of 5 in silico prediction algorithms.

FIG. 5 shows association with body mass index of GPR75 pLOF variants within age and sex subgroups. Abbreviations: Confidence interval, CI; standard deviation, SD; body mass index, BMI; alternative allele frequency, AAF; P-value, p; reference-reference genotype, RR; reference-alternative genotype, RA; alternative-alternative genotype, AA; kilograms per square meter, kg/m²; predicted loss of function, pLOF.

FIG. 6 shows association with risk of obesity for GPR75 pLOF variants. Abbreviations: OR, odds ratio; CI, confidence intervals; P-value, p; AAF, alternative allele frequency; reference-reference genotype, RR; reference-alternative genotype, RA; alternative-alternative genotype, AA; pLOF, predicted loss of function. Results are from a meta-analysis of the UKB, GHS and MCPS studies.

FIG. 8 shows association of GPR75 pLOF variants with self-reported thinner than average comparative body size at age 10 in UKB. Abbreviations: predicted loss of function, pLOF; UK Biobank, UKB; alternative allele frequency, AAF; confidence interval, CI; odds ratio, OR; P-value, p; reference-reference genotype, RR; reference-alternative genotype, RA; alternative-alternative genotype, AA.

FIG. 10 shows association of pLOF genetic variants in GPR75 with cardio-metabolic phenotypes in the UKB, GHS and MCPS studies. Abbreviations: P-value, p; SD, standard deviations; CI, confidence intervals; pLOF, predicted loss of function; AAF, alternative allele frequency; RR, reference-reference genotype; RA, reference-alternative heterozygous genotype; AA, alternative-alternative homozygous genotype; Hemoglobin A1C, HbA1c; Aspartate transaminase, AST; Alanine transaminase, ALT; High-density lipoprotein cholesterol, HDL-C; Low-density lipoprotein cholesterol, LDL-C; milligrams per deciliter, mg/dL; millimetre of mercury, mmHg; units per liter, U/L.

FIG. 12 shows GPR75 predicted loss of function variants identified by exome-sequencing. The Table lists the predicted loss of function (pLOF) variants in the GPR75 gene found by exome sequencing which contributed to the gene burden analysis. Imputation INFO score values below 0.3 are typically considered to be of very low quality. Abbreviations: chromosome, position, reference, alternative, CPRA; alternative allele frequency, AAF; complementary DNA, cDNA; human genome variation society, HGVS.

FIG. 13 shows no association with BMI for the burden of rare nonsynonymous variants in ASB3 or GPR75-ASB3. Abbreviations: alternative allele frequency, AAF; confidence intervals, CI; standard deviation, SD; body mass index, BMI; kilograms per square meter, kg/m$^2$; P-value, p; reference-reference genotype, RR; reference-alternative genotype, RA; alternative-alternative genotype, AA; predicted loss of function, pLOF.

FIG. 14 shows association with BMI of the burden of pLOF variants in GPR75 after adjusting for ASB3, GPR75-ASB3 and common variants genotypes in the region. Abbreviations: Confidence interval, CI; standard deviation, SD; body mass index, BMI; kilograms per square meter, kg/m$^2$; P-value, p; alternative allele frequency, AAF; reference-reference genotype, RR; reference-alternative genotype, RA; alternative-alternative genotype, AA; predicted loss of function, pLOF. * standard covariates included all fine-mapped common variants from the GWAS analysis including rs59428052 near ASB3.

FIG. 15 shows common variants associated with BMI at the GPR75 locus. The Table reports a list of 26 common variants which were associated with BMI at the genome-wide threshold of statistical significance ($p<5\times10^{-8}$) within 500 kb either side of GPR75 in Europeans. The variants are annotated to the nearest gene, and whether they are in LD ($R^2>0.8$) with an eQTL sentinel or nonsynonymous coding variant. At the GPR75 locus, no common variants were associated with BMI at genome-wide significance in admixed Americans. Abbreviations: chromosome, position, reference, alternative, CPRA; alternative allele frequency, AAF; posterior probability of causal association, PPA; linkage disequilibrium, LD; expression quantitative trait loci, eQTL.

FIG. 17 shows association of pLOF genetic variants in GPR75 with body mass index in sensitivity analyses. The Table reports leave-one-out analyses excluding one genetic variant at a time as well as an analysis excluding variants associated with lower BMI in individual-variant analyses (bottom row). Abbreviations: CI, confidence intervals; SD, standard deviation; BMI, body mass index; p, P-value; pLOF, predicted loss of function.

FIG. 18 shows predicted loss of function variants in GPR75 associated with BMI in individual variant analyses. This Table reports association statistics for GPR75 pLOF variants which were included in the gene burden analysis and were also individually associated with BMI at an inverse-variance weighted meta-analysis $p<0.05$. Abbreviations: AAF, alternative allele frequency; CI, confidence intervals; SD, standard deviation; BMI, body mass index; P-value, p; frame shift, fs; pLOF, predicted loss of function.

FIG. 20 shows association with BMI of N- vs C-terminal truncating genetic variants in GPR75. Abbreviations: CI, confidence intervals; SD, standard deviation; BMI, body mass index; p, p-value; AAF, alternative allele frequency; RR, reference-reference genotype; RA, reference-alternative heterozygous genotype; AA, alternative-alternative homozygous genotype; kg/m$^2$, kilograms per square meter.

FIG. 21 shows average body weights in GPR75 WT (designated with HIST and WT) and homozygote knockouts (designated with KO) male (top panel) and female (bottom panel) mice.

FIG. 24 shows weight-gain during high-fat diet and metabolic phenotype in mice with a genetic deletion of Gpr75. Panel A shows weekly body weight gain during a 14-weeks high-fat diet challenge; Panel B shows changes in fasting blood glucose before and after the high-fat diet challenge; Panel C shows results of a glucose tolerance test at the end of the 14-week high-fat diet challenge; Panel D shows plasma insulin at the end of the 14-week high-fat diet challenge. Each panel shows results in Gpr75$^{+/+}$ (WT), Gpr75$^{+/-}$ (HET), and Gpr75$^{-/-}$ (KO) mice. Number of mice included in each group and analysis are in parenthesis. Results are presented as mean±standard error. Abbreviations: ns, not statistically-significant; *p<0.05, p<0.01, *p<0.001, ****p<0.0001 by two-way ANOVA with Tukey's multiple comparisons test.

DESCRIPTION

Figure 4:
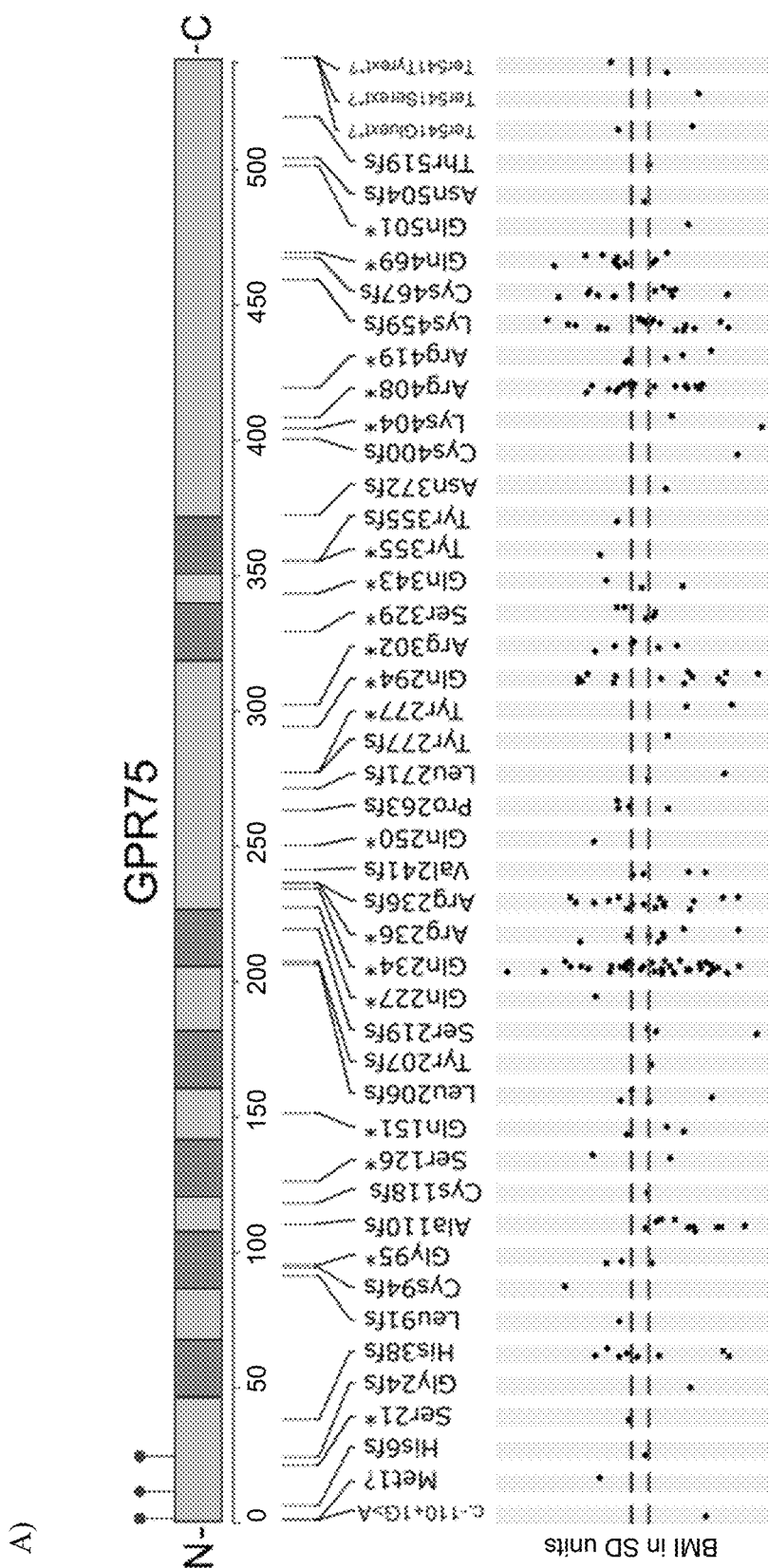
FIG. 4 shows protein-truncating variants in GPR75 associated with lower body mass index in humans. Panel A shows a linear model of the GPR75 protein (SEQ ID NO: 55) and its domains (top; intra- and extra-cellular domains in yellow, transmembrane domains in orange), the distribution on the GPR75 protein of 46 predicted loss of function variants found by exome sequencing (middle) and the distribution of BMI in standardized units among heterozygous carriers of each variant (bottom). In the bottom sub-panel, horizontal blue bars show the mean BMI in non-carriers, while horizontal red bars show the overall covariates-adjusted mean BMI in carriers of any predicted loss-of-function genetic variant in GPR75. Panel B shows meta-analysis of the association with BMI of predicted loss-of-function variants in GPR75 in discovery and additional cohorts. Abbreviations: CI, confidence interval; RR, reference-reference genotype; RA, reference-alternative heterozygous genotype; AA, alternative-alternative homozygous genotype; DHS, Dallas Heart Study; SINAI, Mount Sinai BioMe cohort; DUKE, Duke Catheterization Genetics cohort; TAICHI, Taiwanese Chinese persons from the Taiwan Metabochip Consortium; PMBB, University of Pennsylvania Medicine BioBank; MALMO, Malmö Diet and Cancer Study; AFR, African ancestry; AMR; American ancestry; EAS, East Asian ancestry; EUR, European ancestry; SAS, South Asian ancestry. MCPS included individuals of Admixed American ancestry.
Figure 4:
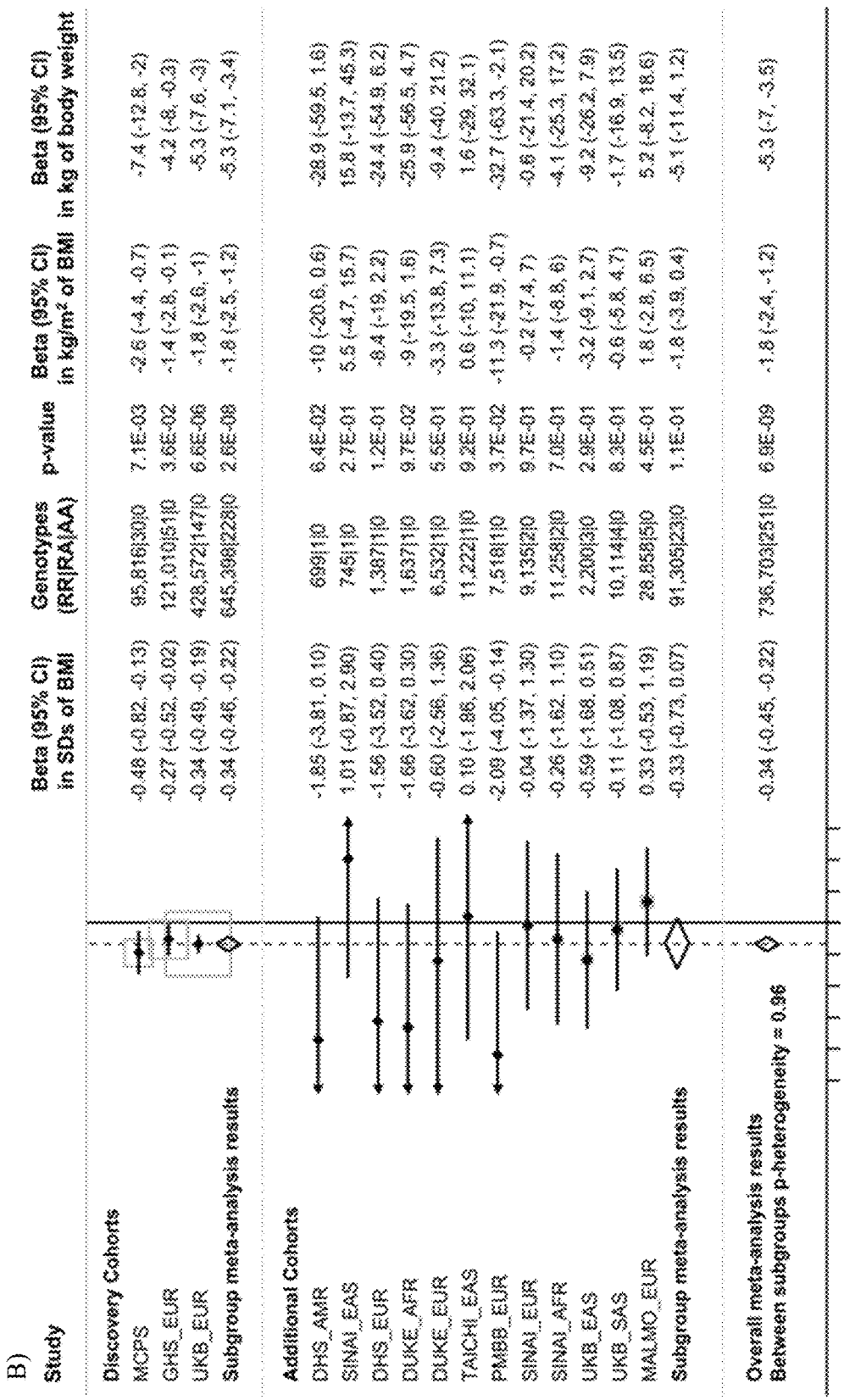

Various terms relating to aspects of the present disclosure are used throughout the specification and claims. Such terms are to be given their ordinary meaning in the art, unless otherwise indicated. Other specifically defined terms are to be construed in a manner consistent with the definitions provided herein.

Unless otherwise expressly stated, it is in no way intended that any method or aspect set forth herein be construed as requiring that its steps be performed in a specific order. Accordingly, where a method claim does not specifically state in the claims or descriptions that the steps are to be limited to a specific order, it is in no way intended that an order be inferred, in any respect. This holds for any possible non-expressed basis for interpretation, including matters of logic with respect to arrangement of steps or operational flow, plain meaning derived from grammatical organization or punctuation, or the number or type of aspects described in the specification.

As used herein, the singular forms "a," "an" and "the" include plural referents unless the context clearly dictates otherwise.

As used herein, the term "about" means that the recited numerical value is approximate and small variations would not significantly affect the practice of the disclosed embodiments. Where a numerical value is used, unless indicated otherwise by the context, the term "about" means the numerical value can vary by ±10% and remain within the scope of the disclosed embodiments.

As used herein, the term "comprising" may be replaced with "consisting" or "consisting essentially of" in particular embodiments as desired.

As used herein, the term "isolated", in regard to a nucleic acid molecule or a polypeptide, means that the nucleic acid molecule or polypeptide is in a condition other than its native environment, such as apart from blood and/or animal tissue. In some embodiments, an isolated nucleic acid molecule or polypeptide is substantially free of other nucleic acid molecules or other polypeptides, particularly other nucleic acid molecules or polypeptides of animal origin. In some embodiments, the nucleic acid molecule or polypeptide can be in a highly purified form, i.e., greater than 95% pure or greater than 99% pure. When used in this context, the term "isolated" does not exclude the presence of the same nucleic acid molecule or polypeptide in alternative physical forms, such as dimers or alternatively phosphorylated or derivatized forms.

As used herein, the terms "nucleic acid", "nucleic acid molecule", "nucleic acid sequence", "polynucleotide", or "oligonucleotide" can comprise a polymeric form of nucleotides of any length, can comprise DNA and/or RNA, and can be single-stranded, double-stranded, or multiple stranded. One strand of a nucleic acid also refers to its complement.

As used herein, the term "subject" includes any animal, including mammals. Mammals include, but are not limited to, farm animals (such as, for example, horse, cow, pig), companion animals (such as, for example, dog, cat), laboratory animals (such as, for example, mouse, rat, rabbits), and non-human primates (such as, for example, apes and monkeys). In some embodiments, the subject is a human. In some embodiments, the subject is a patient under the care of a physician.

Variants in the GPR75 gene associated with a decreased risk of developing obesity, excessive weight, elevated BMI, elevated body fat mass, percentage, or volume, and/or excessive food intake, in subjects has been identified in accordance with the present disclosure. For example, a genetic alteration that deletes the CCAGTAG heptanucleotide of positions 5,540-5,546 in the human GPR75 reference (see, SEQ ID NO:1), or changes the guanine nucleotide of position 5,557 in the human GPR75 reference (see, SEQ ID NO:1) to adenine, or the cytosine nucleotide of position 5,911 in the human GPR75 reference (see, SEQ ID NO:1) to thymine, or deletes the AAAG tetranucleotide at positions 5,920-5,923 in the human GPR75 reference (see, SEQ ID NO:1), or inserts the thymine nucleotide at position 6,411 in the human GPR75 reference (see, SEQ ID NO:1) has been observed to indicate that the human having such an alteration may have a decreased risk of developing obesity, excessive weight, elevated BMI, elevated body fat mass, percentage, or volume, and/or excessive food intake. It is believed that no variants of the GPR75 gene or protein have any known association with obesity, body weight, BMI, body fat mass, percentage, or volume, and/or body lean mass, percentage, or volume. Altogether, the genetic analyses described herein surprisingly indicate that the GPR75 gene and, in particular, variants in the GPR75 gene, associate with a decreased risk of developing obesity, associate with lower weight, lower BMI, lower body fat mass, percentage, or volume, and/or lower lean body mass, percentage, or volume. Therefore, subjects that are GPR75 reference that have an increased risk of developing obesity, excessive weight, elevated BMI, elevated body fat mass, percentage, or volume, and/or excessive food intake may be treated such that obesity is prevented, the symptoms thereof are reduced, and/or development of symptoms is repressed. Accordingly, the present disclosure provides methods of leveraging the identification of such variants in subjects to identify or stratify risk in such subjects of developing obesity, excessive weight, elevated BMI, elevated body fat mass, percentage, or volume, and/or excessive food intake, or to diagnose subjects as having an increased risk of developing obesity, excessive weight, elevated BMI, elevated body fat mass, percentage, or volume, and/or excessive food intake, such that subjects at risk or subjects with active disease may be treated accordingly. Additionally, the present disclosure provides isolated GPR75 variant genomic nucleic acid molecules, variant mRNA molecules, and variant cDNA molecules. Also provided herein are GPR75 loss-of-function variant nucleic acid molecules discovered to be associated with decreased risk of developing obesity, excessive weight, elevated BMI, elevated body fat mass, percentage, or volume, and/or excessive food intake.

Additional missense variants in the GPR75 gene that may be associated with a decreased risk of developing obesity, excessive weight, elevated BMI, elevated body fat mass, percentage, or volume, and/or excessive food intake comprise (according to GRCh38/hg38 (December 2013) human genome assembly) (and, hence, can be included in any of the embodiments described herein): a substitution of thymine with cytosine at the chromosome 2 position 53,854,656 resulting in replacement of glutamine with arginine at a position corresponding to position 34 according to SEQ ID NO:55; a substitution of guanine with alanine at the chromosome 2 position 53,854,330 resulting in replacement of arginine with tryptophan at a position corresponding to position 143 according to SEQ ID NO:55; a substitution of thymine with cytosine at the chromosome 2 position 53,854,321 resulting in replacement of methionine with valine at a position corresponding to position 146 according to SEQ ID NO:55; a substitution of cytosine with guanine at the chromosome 2 position 53,854,191 resulting in replacement of cysteine with serine at a position corresponding to position 189 according to SEQ ID NO:55; a substitution of alanine with guanine at the chromosome 2 position 53,853,780 resulting in replacement of isoleucine with threonine at a position corresponding to position 326 according to SEQ ID NO:55; a substitution of thymine with adenine at the chromosome 2 position 53,853,634 resulting in replacement of isoleucine with leucine at a position corresponding to position 375 according to SEQ ID NO:55; and a substitution of cytosine with thymine at the chromosome 2 position 53,853,181 resulting in replacement of glutamic acid with lysine at a position corresponding to position 526 according to SEQ ID NO:55.

Additional variants in the GPR75 gene may be associated with an increased risk of developing obesity, excessive weight, elevated BMI, elevated body fat mass, percentage, or volume, and/or excessive food intake, in subjects, and they may be considered gain-of-function (GOF) variants. Such GOF may include (according to GRCh38/hg38 (December 2013) human genome assembly): a substitution of adenine with thymine at the chromosome 2 position 53,854,437 resulting in replacement of phenylalanine with tyrosine at position corresponding to position 107 according to SEQ ID NO:55; and a substitution of guanine with adenine at the chromosome 2 position 53,853,697 resulting in replacement of leucine with phenylalanine at position corresponding to position 354 according to SEQ ID NO:55. Thus, subjects having either variant may be treated with a GPR75 inhibitor. Such subjects can be assessed for the risk of developing obesity, excessive weight, elevated BMI, elevated body fat mass, percentage, or volume, and/or excessive food intake by detecting the presence of a GOF variant.

For purposes of the present disclosure, any particular human can be categorized as having one of three GPR75 genotypes: i) GPR75 reference; ii) heterozygous for a GPR75 missense variant nucleic acid molecule encoding a predicted loss-of-function GPR75 polypeptide; or iii) homozygous for a GPR75 missense variant nucleic acid molecule encoding a predicted loss-of-function GPR75 polypeptide. A human is GPR75 reference when the human does not have a copy of a GPR75 missense variant nucleic acid molecule. A human is heterozygous for a GPR75 missense variant nucleic acid molecule encoding a predicted loss-of-function GPR75 polypeptide when the human has a single copy of a GPR75 missense variant nucleic acid molecule encoding a predicted loss-of-function GPR75 polypeptide. As used herein, a GPR75 missense variant nucleic acid molecule is any GPR75 nucleic acid molecule (such as, a genomic nucleic acid molecule, an mRNA molecule, or a cDNA molecule) encoding a GPR75 polypeptide having a partial loss-of-function, a complete loss-of-function, a predicted partial loss-of-function, or a predicted complete loss-of-function. A human who has a GPR75 polypeptide having a partial loss-of-function (or predicted partial loss-of-function) is hypomorphic for GPR75. The GPR75 predicted loss-of-function variant nucleic acid molecule can be any nucleic acid molecule encoding GPR75 Ala110fs, Ala116Thr, Tyr207Cys, Gln234Stop, Arg236fs, or Cys400fs. The GPR75 missense variant nucleic acid molecule can also be any nucleic acid molecule encoding Lys404* and Ser219fs, or can be c.-110+1G>A. A human is homozygous for a GPR75 missense variant nucleic acid molecule encoding a predicted loss-of-function GPR75 polypeptide when the human has two copies of a GPR75 missense variant nucleic acid molecule.

For subjects that are genotyped or determined to be GPR75 reference, such subjects have an increased risk of developing obesity, excessive weight, elevated BMI, elevated body fat mass, percentage, or volume, and/or excessive food intake. For subjects that are genotyped or determined to be either GPR75 reference or heterozygous for a GPR75 missense variant nucleic acid molecule encoding a predicted loss-of-function GPR75 polypeptide, such subjects can be treated with a GPR75 inhibitor.

In any of the embodiments described herein, the GPR75 missense variant nucleic acid molecule can be any GPR75 nucleic acid molecule (such as, for example, genomic nucleic acid molecule, mRNA molecule, or cDNA molecule) encoding a GPR75 polypeptide having a partial loss-of-function, a complete loss-of-function, a predicted partial loss-of-function, or a predicted complete loss-of-function. For example, the GPR75 missense variant nucleic acid molecule can be any nucleic acid molecule encoding GPR75 Ala110fs, Ala116Thr, Tyr207Cys, Gln234Stop, Arg236fs, or Cys400fs. The GPR75 missense variant nucleic acid molecule can also be any nucleic acid molecule encoding Lys404* and Ser219fs, or can be c.-110+1G>A.

GPR75 missense variant nucleic acid molecules also include, but are not limited to, 2:53853134:T:G, 2:53853135:T:G, 2:53853136:A:C, 2:53853200:GGT:G, 2:53853245:GT:G, 2:53853256:G:A, 2:53853352:G:A, 2:53853354:CCA:C, 2:53853382:TG:T, 2:53853502:T:A, 2:53853535:G:A, 2:53853547:T:A, 2:53853560:G:GA, 2:53853641:GTT:G, 2:53853680:CAATTCAAACTGGT:C, 2:53853692:G:T, 2:53853730:G:A, 2:53853771:G:C, 2:53853853:G:A, 2:53853877:G:A, 2:53853926:G:T, 2:53853927:T:TA, 2:53853946:G:GT, 2:53853967:TGG:T, 2:53854009:G:A, 2:53854037:A:AG, 2:53854045:ACTTT:A, 2:53854051:T:A, 2:53854057:G:A, 2:53854078:G:A, 2:53854099:CAG:C, 2:53854135:CAT:C, 2:53854137:TAGAG:T, 2:53854306:G:A, 2:53854380:G:C, 2:53854409:A:AG, 2:53854421:ACTACTGG:A, 2:53854474:C:A, 2:53854476:C:CA, 2:53854485:AG:A, 2:53854644:TG:T, 2:53854685:TC:T, 2:53854695:G:T, 2:53854740:TG:T, 2:53854755:A:G, and 2:53859827:C:T (according to GRCh38/hg38 (December 2013) human genome assembly).

In any of the embodiments described herein, the GPR75 predicted loss-of-function polypeptide can be any GPR75 polypeptide having a partial loss-of-function, a complete loss-of-function, a predicted partial loss-of-function, or a predicted complete loss-of-function. In any of the embodiments described herein, the GPR75 predicted loss-of-function polypeptide can be any of the GPR75 polypeptides described herein including, for example, GPR75 Ala110fs, Ala116Thr, Tyr207Cys, Gln234Stop, Arg236fs, or Cys400fs. The GPR75 predicted loss-of-function polypeptide can also be Lys404* or Ser219fs.

In any of the embodiments described herein, the subject can be obese, or have excessive weight, elevated BMI, elevated body fat mass, percentage, or volume, and/or excessive food intake. In any of the embodiments described herein, the subject can be obese. In any of the embodiments described herein, the subject can have excessive weight. In any of the embodiments described herein, the subject can have elevated BMI. In any of the embodiments described herein, the subject can have elevated body fat mass, percentage, or volume. In any of the embodiments described herein, the subject can have excessive food intake.

Symptoms of obesity include, but are not limited to, excess body fat accumulation (particularly around the waist), breathlessness, increased sweating, snoring, inability to cope with sudden physical activity, feeling very tired every day, back and joint pains, skin problems (from moisture accumulating in the folds of skin).

The present disclosure provides methods of treating a subject having obesity, the methods comprising administering a GPR75 inhibitor to the subject. In some embodiments, the subject is GPR75 reference or is heterozygous for a GPR75 missense variant nucleic acid molecule encoding a predicted loss-of-function GPR75 polypeptide.

The present disclosure also provides methods of treating a subject having excessive weight, the methods comprising administering a GPR75 inhibitor to the subject. In some embodiments, the subject is GPR75 reference or is heterozygous for a GPR75 missense variant nucleic acid molecule encoding a predicted loss-of-function GPR75 polypeptide.

The present disclosure also provides methods of treating a subject having elevated BMI, the methods comprising administering a GPR75 inhibitor to the subject. In some embodiments, the subject is GPR75 reference or is heterozygous for a GPR75 missense variant nucleic acid molecule encoding a predicted loss-of-function GPR75 polypeptide.

The present disclosure also provides methods of treating a subject having elevated body fat mass, percentage, or volume, the methods comprising administering a GPR75 inhibitor to the subject. In some embodiments, the subject is GPR75 reference or is heterozygous for a GPR75 missense variant nucleic acid molecule encoding a predicted loss-of-function GPR75 polypeptide.

The present disclosure also provides methods of treating a subject having excessive food intake, the methods comprising administering a GPR75 inhibitor to the subject. In some embodiments, the subject is GPR75 reference or is heterozygous for a GPR75 missense variant nucleic acid molecule encoding a predicted loss-of-function GPR75 polypeptide.

The present disclosure also provides methods of treating a subject to prevent weight gain or to maintain weight loss, the method comprising administering a GPR75 inhibitor to the subject. In some embodiments, the subject is GPR75 reference or is heterozygous for a GPR75 missense variant nucleic acid molecule encoding a predicted loss-of-function GPR75 polypeptide.

In any of the embodiments described herein in which a subject is treated with a GPR75 inhibitor, the subject can be GPR75 reference (i.e., the subject does not have a copy of a GPR75 missense variant nucleic acid molecule encoding a predicted loss-of-function GPR75 polypeptide). In any of the embodiments described herein in which a subject is treated with a GPR75 inhibitor, the subject can be heterozygous for a GPR75 missense variant nucleic acid molecule encoding a predicted loss-of-function GPR75 polypeptide (i.e., the subject only has a single copy a reference GPR75 nucleic acid molecule). The subject's genotype need not be determined at the time of the administration of the GPR75 inhibitor.

In some embodiments, the GPR75 inhibitor comprises an inhibitory nucleic acid molecule. Examples of inhibitory nucleic acid molecules include, but are not limited to, antisense nucleic acid molecules, small interfering RNAs (siRNAs), and short hairpin RNAs (shRNAs). Such inhibitory nucleic acid molecules can be designed to target any region of a GPR75 nucleic acid molecule, such as an mRNA molecule. In some embodiments, the antisense RNA, siRNA, or shRNA hybridizes to a sequence within a GPR75 genomic nucleic acid molecule or mRNA molecule and decreases expression of the GPR75 polypeptide in a cell in the subject. In some embodiments, the GPR75 inhibitor comprises an antisense RNA that hybridizes to a GPR75 genomic nucleic acid molecule or mRNA molecule and decreases expression of the GPR75 polypeptide in a cell in the subject. In some embodiments, the antisense nucleic acid molecules comprise or consist of the nucleotide sequences set forth in SEQ ID NOs:109-529. In some embodiments, the GPR75 inhibitor comprises an siRNA that hybridizes to a GPR75 genomic nucleic acid molecule or mRNA molecule and decreases expression of the GPR75 polypeptide in a cell in the subject. In some embodiments, the siRNA molecules comprise or consist of the nucleotide sequences (sense and antisense strand pairs) set forth in SEQ ID NOs:530-1457 (i.e., SEQ ID NO:530 and SEQ ID NO:531, for example, form the sense and antisense strands, respectively, of an siRNA molecule; likewise with the sense and antisense strands of the remaining siRNA molecules set forth in SEQ ID NOs:530-1457). In some embodiments, the GPR75 inhibitor comprises an shRNA that hybridizes to a GPR75 genomic nucleic acid molecule or mRNA molecule and decreases expression of the GPR75 polypeptide in a cell in the subject. Suitable GPR75-specific siRNAs and shRNAs are disclosed in, for example, Garcia et al., Circ. Res., 2017, 120, 1776-1788.

The inhibitory nucleic acid molecules disclosed herein can comprise RNA, DNA, or both RNA and DNA. The inhibitory nucleic acid molecules can also be linked or fused to a heterologous nucleic acid sequence, such as in a vector, or a heterologous label. For example, the inhibitory nucleic acid molecules disclosed herein can be within a vector or as an exogenous donor sequence comprising the inhibitory nucleic acid molecule and a heterologous nucleic acid sequence. The inhibitory nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidase (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The disclosed inhibitory nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The inhibitory nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, $-O[(CH_2)_nO]_mCH_3$, $-O(CH_2)_nOCH_3$, $-O(CH_2)_nNH_2$, $-O(CH_2)_nCH_3$, $-O(CH_2)_n-ONH_2$, and $-O(CH_2)_nON[(CH_2)_nCH_3)]_2$, where n and m, independently, are from 1 to about 10. Other modifications at the 2' position include, but are not limited to, $C_{1-10}$alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as $CH_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

In some embodiments, the antisense nucleic acid molecules are gapmers, whereby the first one to seven nucleotides at the 5' and 3' ends each have 2'-methoxyethyl (2'-MOE) modifications. In some embodiments, the first five nucleotides at the 5' and 3' ends each have 2'-MOE modifications. In some embodiments, the first one to seven nucleotides at the 5' and 3' ends are RNA nucleotides. In some embodiments, the first five nucleotides at the 5' and 3' ends are RNA nucleotides. In some embodiments, each of the backbone linkages between the nucleotides is a phosphorothioate linkage.

In some embodiments, the siRNA molecules have termini modifications. In some embodiments, the 5' end of the antisense strand is phosphorylated. In some embodiments, 5'-phosphate analogs that cannot be hydrolyzed, such as 5'-(E)-vinyl-phosphonate are used.

In some embodiments, the siRNA molecules have backbone modifications. In some embodiments, the modified phosphodiester groups that link consecutive ribose nucleosides have been shown to enhance the stability and in vivo bioavailability of siRNAs The non-ester groups (—OH, =O) of the phosphodiester linkage can be replaced with sulfur, boron, or acetate to give phosphorothioate, boranophosphate, and phosphonoacetate linkages. In addition, substituting the phosphodiester group with a phosphotriester can facilitate cellular uptake of siRNAs and retention on serum components by eliminating their negative charge. In some embodiments, the siRNA molecules have sugar modifications. In some embodiments, the sugars are deprotonated (reaction catalyzed by exo- and endonucleases) whereby the 2'-hydroxyl can act as a nucleophile and attack the adjacent phosphorous in the phosphodiester bond. Such alternatives include 2'-O-methyl, 2'-O-methoxyethyl, and 2'-fluoro modifications.

In some embodiments, the siRNA molecules have base modifications. In some embodiments, the bases can be substituted with modified bases such as pseudouridine, 5'-methylcytidine, N6-methyladenosine, inosine, and N7-methylguanosine.

In some embodiments, the siRNA molecules are conjugated to lipids. Lipids can be conjugated to the 5' or 3' termini of siRNA to improve their in vivo bioavailability by allowing them to associate with serum lipoproteins. Representative lipids include, but are not limited to, cholesterol and vitamin E, and fatty acids, such as palmitate and tocopherol.

In some embodiments, a representative siRNA has the following formula:

Sense: mN*mN*/i2FN/mN/i2FN/mN/i2FN/mN/
i2FN/mN/i2FN/mN/i2FN/mN/i2FN/mN/i2FN/
*mN*/32FN/

Antisense: /52FN/*/i2FN/*mN/i2FN/mN/i2FN/mN/
i2FN/mN/i2FN/mN/i2FN/mN/i2FN/mN/i2FN/
mN/i2FN/mN*N*N wherein: "N" is the base; "2F" is a 2'-F modification; "m" is a 2'-O-methyl modification, "I" is an internal base; and "*" is a phosphorothioate backbone linkage.

The present disclosure also provides vectors comprising any one or more of the inhibitory nucleic acid molecules disclosed herein. In some embodiments, the vectors comprise any one or more of the inhibitory nucleic acid molecules disclosed herein and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

The present disclosure also provides compositions comprising any one or more of the inhibitory nucleic acid molecules disclosed herein. In some embodiments, the composition is a pharmaceutical composition. In some embodiments, the compositions comprise a carrier and/or excipient. Examples of carriers include, but are not limited to, poly (lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

In some embodiments, the GPR75 inhibitor comprises a nuclease agent that induces one or more nicks or double-strand breaks at a recognition sequence(s) or a DNA-binding protein that binds to a recognition sequence within a GPR75 genomic nucleic acid molecule. The recognition sequence can be located within a coding region of the GPR75 gene, or within regulatory regions that influence the expression of the gene. A recognition sequence of the DNA-binding protein or nuclease agent can be located in an intron, an exon, a promoter, an enhancer, a regulatory region, or any non-protein coding region. The recognition sequence can include or be proximate to the start codon of the GPR75 gene. For example, the recognition sequence can be located about 10, about 20, about 30, about 40, about 50, about 100, about 200, about 300, about 400, about 500, or about 1,000 nucleotides from the start codon. As another example, two or more nuclease agents can be used, each targeting a nuclease recognition sequence including or proximate to the start codon. As another example, two nuclease agents can be used, one targeting a nuclease recognition sequence including or proximate to the start codon, and one targeting a nuclease recognition sequence including or proximate to the stop codon, wherein cleavage by the nuclease agents can result in deletion of the coding region between the two nuclease recognition sequences. Any nuclease agent that induces a nick or double-strand break into a desired recognition sequence can be used in the methods and compositions disclosed herein. Any DNA-binding protein that binds to a desired recognition sequence can be used in the methods and compositions disclosed herein.

Suitable nuclease agents and DNA-binding proteins for use herein include, but are not limited to, zinc finger protein or zinc finger nuclease (ZFN) pair, Transcription Activator-Like Effector (TALE) protein or Transcription Activator-Like Effector Nuclease (TALEN), or Clustered Regularly Interspersed Short Palindromic Repeats (CRISPR)/CRISPR-associated (Cas) systems. The length of the recognition sequence can vary, and includes, for example, recognition sequences that are about 30-36 bp for a zinc finger protein or ZFN pair, about 15-18 bp for each ZFN, about 36 bp for a TALE protein or TALEN, and about 20 bp for a CRISPR/Cas guide RNA.

In some embodiments, CRISPR/Cas systems can be used to modify a GPR75 genomic nucleic acid molecule within a cell. The methods and compositions disclosed herein can employ CRISPR-Cas systems by utilizing CRISPR complexes (comprising a guide RNA (gRNA) complexed with a Cas protein) for site-directed cleavage of GPR75 nucleic acid molecules.

Cas proteins generally comprise at least one RNA recognition or binding domain that can interact with gRNAs. Cas proteins can also comprise nuclease domains (such as, for example, DNase or RNase domains), DNA binding domains, helicase domains, protein-protein interaction domains, dimerization domains, and other domains. Suitable Cas proteins include, for example, a wild type Cas9 protein and a wild type Cpf1 protein (such as, for example, FnCpf1). A Cas protein can have full cleavage activity to create a double-strand break in a GPR75 genomic nucleic acid molecule or it can be a nickase that creates a single-strand break in a GPR75 genomic nucleic acid molecule. Additional examples of Cas proteins include, but are not limited to, Cas1, Cas1B, Cast, Cas3, Cas4, Cas5, Cas5e (CasD), Cas6, Cas6e, Cas6f, Cas7, Cas8a1, Cas8a2, Cas8b, Cas8c, Cas9 (Csn1 or Csx12), Cas10, Cas10d, CasF, CasG, CasH, Csy1, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cu1966, and homologs or modified versions thereof. Cas proteins can also be operably linked to heterologous polypeptides as fusion proteins. For example, a Cas protein can be fused to a cleavage domain, an epigenetic modification domain, a transcriptional activation domain, or a transcriptional repressor domain. Cas proteins can be provided in any form. For example, a Cas protein can be provided in the form of a protein, such as a Cas protein complexed with a gRNA. Alternately, a Cas protein can be provided in the form of a nucleic acid molecule encoding the Cas protein, such as an RNA or DNA.

In some embodiments, targeted genetic modifications of GPR75 genomic nucleic acid molecules can be generated by contacting a cell with a Cas protein and one or more gRNAs that hybridize to one or more gRNA recognition sequences within a target genomic locus in the GPR75 genomic nucleic acid molecule. For example, a gRNA recognition sequence can be located within a region of SEQ ID NO:1. The gRNA recognition sequence can also include or be proximate to a position corresponding to: position 5,540-5,546, 5,557, 5,911, 5,920-5,923, or 6,411 according to SEQ ID NO:1. For example, the gRNA recognition sequence can be located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to: position 5,540-5,546, 5,557, 5,911, 5,920-5,923, or 6,411 according to SEQ ID NO:1. The gRNA recognition sequence can include or be proximate to the start codon of a GPR75 genomic nucleic acid molecule or the stop codon of a GPR75 genomic nucleic acid molecule. For example, the gRNA recognition sequence can be located from about 10, from about 20, from about 30, from about 40, from about 50, from about 100, from about 200, from about 300, from about 400, from about 500, or from about 1,000 nucleotides of the start codon or the stop codon.

The gRNA recognition sequences within a target genomic locus in a GPR75 genomic nucleic acid molecule are located near a Protospacer Adjacent Motif (PAM) sequence, which is a 2-6 base pair DNA sequence immediately following the DNA sequence targeted by the Cas9 nuclease. The canonical PAM is the sequence 5'-NGG-3' where "N" is any nucleobase followed by two guanine ("G") nucleobases. gRNAs can transport Cas9 to anywhere in the genome for gene editing, but no editing can occur at any site other than one at which Cas9 recognizes PAM. In addition, 5'-NGA-3' can be a highly efficient non-canonical PAM for human cells. Generally, the PAM is about 2-6 nucleotides downstream of the DNA sequence targeted by the gRNA. The PAM can flank the gRNA recognition sequence. In some embodiments, the gRNA recognition sequence can be flanked on the 3' end by the PAM. In some embodiments, the gRNA recognition sequence can be flanked on the 5' end by the PAM. For example, the cleavage site of Cas proteins can be about 1 to about 10, about 2 to about 5 base pairs, or three base pairs upstream or downstream of the PAM sequence. In some embodiments (such as when Cas9 from S. pyogenes or a closely related Cas9 is used), the PAM sequence of the non-complementary strand can be 5'-NGG-3', where N is any DNA nucleotide and is immediately 3' of the gRNA recognition sequence of the non-complementary strand of the target DNA. As such, the PAM sequence of the complementary strand would be 5'-CCN-3', where N is any DNA nucleotide and is immediately 5' of the gRNA recognition sequence of the complementary strand of the target DNA.

A gRNA is an RNA molecule that binds to a Cas protein and targets the Cas protein to a specific location within a GPR75 genomic nucleic acid molecule. An exemplary gRNA is a gRNA effective to direct a Cas enzyme to bind to cleave a GPR75 genomic nucleic acid molecule, wherein the gRNA comprises a DNA-targeting segment that hybridizes to a gRNA recognition sequence within the GPR75 genomic nucleic acid molecule that includes or is proximate to a position corresponding to: position 5,540-5,546, 5,557, 5,911, 5,920-5,923, or 6,411 according to SEQ ID NO:1. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of a position corresponding to: position 5,540-5,546, 5,557, 5,911, 5,920-5,923, or 6,411 according to SEQ ID NO:1. Other exemplary gRNAs comprise a DNA-targeting segment that hybridizes to a gRNA recognition sequence present within a GPR75 genomic nucleic acid molecule that includes or is proximate to the start codon or the stop codon. For example, a gRNA can be selected such that it hybridizes to a gRNA recognition sequence that is located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the start codon or located from about 5, from about 10, from about 15, from about 20, from about 25, from about 30, from about 35, from about 40, from about 45, from about 50, from about 100, from about 200, from about 300, from about 400, from about 500, or from about 1,000 nucleotides of the stop codon. Suitable gRNAs can comprise from about 17 to about 25 nucleotides, from about 17 to about 23 nucleotides, from about 18 to about 22 nucleotides, or from about 19 to about 21 nucleotides. In some embodiments, the gRNAs can comprise 20 nucleotides.

Examples of suitable gRNA recognition sequences located within the human GPR75 reference gene are set forth in Table 1 as SEQ ID NOS:61-98.

TABLE 1

| Guide RNA Recognition Sequences Near GPR75 Variation(s) | | |
|---|---|---|
| Strand | gRNA Recognition Sequence | SEQ ID NO: |
| - | ACACCATCCGGAGCCGGTGCAGG | 61 |
| - | GAAAGCATCCGGGATACTACTGG | 62 |
| + | TGATCGCCCTGCACCGGCTCCGG | 63 |
| + | GCACCGGCTCCGGATGGTGTTGG | 64 |
| + | ACCGGCTCCGGATGGTGTTGGGG | 65 |
| + | CACCGGCTCCGGATGGTGTTGGG | 66 |
| - | GGAAAGGAGGCCGTGCGATTAGG | 67 |
| + | GGGGAAACAGCCTAATCGCACGG | 68 |
| - | CACCATCCGGAGCCGGTGCAGGG | 69 |
| + | TGGCAGTGATCGCCCTGCACCGG | 70 |
| - | CATGATGATGAAGCCTGAACTGG | 71 |
| + | CGCCCTGCACCGGCTCCGGATGG | 72 |
| - | TCCCCAACACCATCCGGAGCCGG | 73 |
| - | CTGTCACTCCACAAATGAAGAGG | 74 |
| - | GACTTGAGCGTTCTTCCGCAGGG | 75 |
| - | GCATCGACTGTGATTACAGGGGG | 76 |
| - | GCCGGCATGGCACACTGGATGGG | 77 |
| - | GAAGCATCGACTGTGATTACAGG | 78 |
| - | AGCATCGACTGTGATTACAGGGG | 79 |
| - | TGACTTGAGCGTTCTTCCGCAGG | 80 |

TABLE 1-continued

Guide RNA Recognition Sequences Near GPR75 Variation(s)

| Strand | gRNA Recognition Sequence | SEQ ID NO: |
|---|---|---|
| + | TCATGATTGCTCAGACCCTGCGG | 81 |
| - | CATCGACTGTGATTACAGGGGGG | 82 |
| - | AAGCATCGACTGTGATTACAGGG | 83 |
| + | TCCAGACCACAGCCTTTCATGGG | 84 |
| + | CCCATGTCCAGTCTGATTGCTGG | 85 |
| - | ACAGAGCCGGCATGGCACACTGG | 86 |
| + | CAGACCACAGCCTTTCATGGGGG | 87 |
| + | TTCATGGGGTCCCTGTGCAGGG | 88 |
| + | AAGACTCGACTTCGAGCCATGGG | 89 |
| + | AAAGACTCGACTTCGAGCCATGG | 90 |
| + | CGACTTCGAGCCATGGGAAAAGG | 91 |
| + | TATATTCTCGGAACAGTGCAGGG | 92 |
| + | CTCTGGTGCCTCCAATACATAGG | 93 |
| + | ATATATTCTCGGAACAGTGCAGG | 94 |
| + | TGCCTCCAATACATAGGCCTGGG | 95 |
| - | AACCCAGGCCTATGTATTGGAGG | 96 |
| - | AAAAACCCAGGCCTATGTATTGG | 97 |
| - | TTCGAGGTTCCCTTTTCCCATGG | 98 |

The Cas protein and the gRNA form a complex, and the Cas protein cleaves the target GPR75 genomic nucleic acid molecule. The Cas protein can cleave the nucleic acid molecule at a site within or outside of the nucleic acid sequence present in the target GPR75 genomic nucleic acid molecule to which the DNA-targeting segment of a gRNA will bind. For example, formation of a CRISPR complex (comprising a gRNA hybridized to a gRNA recognition sequence and complexed with a Cas protein) can result in cleavage of one or both strands in or near (such as, for example, within 1, 2, 3, 4, 5, 6, 7, 8, 9, 10, 20, 50, or more base pairs from) the nucleic acid sequence present in the GPR75 genomic nucleic acid molecule to which a DNA-targeting segment of a gRNA will bind.

Such methods can result, for example, in a GPR75 genomic nucleic acid molecule in which a region of SEQ ID NO:1 is disrupted, the start codon is disrupted, the stop codon is disrupted, or the coding sequence is disrupted or deleted. Optionally, the cell can be further contacted with one or more additional gRNAs that hybridize to additional gRNA recognition sequences within the target genomic locus in the GPR75 genomic nucleic acid molecule. By contacting the cell with one or more additional gRNAs (such as, for example, a second gRNA that hybridizes to a second gRNA recognition sequence), cleavage by the Cas protein can create two or more double-strand breaks or two or more single-strand breaks.

In some embodiments, the GPR75 inhibitor comprises a small molecule. In some embodiments, the GPR75 inhibitor is an inhibitor of CCL5 (RANTES) including, but not limited to, [$^{44}$AANA$^{47}$]-RANTES and Met-CCL$_5$ (see, Braunersreuther et al., Arteriosclerosis, Thrombosis, and Vasc. Biol., 2008, 28, 1090-1096; Proudfoot et al., J. Biol. Chem., 1999, 274, 32478-32485; and Matsui et al., J. Neroimmunol., 2002, 128, 16-22). In some embodiments, the GPR75 inhibitor is an inhibitor of the interaction between GPR75 and 20-Hydroxyeicosatetraenoic acid (20-HETE), including, but not limited to, fatty acid analogs, terminal acetylenic fatty acids, terminal di-bromo fatty acids, sulfonated fatty acids, TS-011, Het0016, 5,14,20-HEDE, 5,14,20-HEDGE, 6,15,20-HEDE, 17-ODYA, DDMS, DDBB, 2,5,8,11,14,17-hexaoxanonadecan-19-yl-20-hydroxyeicosa 6(z), 15(z)-dienote (20-sola), and 6(z),15(z)hyroxyeicosa-6,15-dienamido-diencoic acid (aaa) (see, Miyata et al., Br. J. Pharmacol., 2001, 133, 325-329; Miyata et al., J. Pharmacol. Exp. Ther., 2005, 314, 77-85; Pandey et al., J. Pharmacol. Exp. Ther., 2017, 363, 412-418; and Savas et al., J. Biol. Chem., 2016, 291, 16904-16919). In some embodiments, the GPR75 inhibitor is any of the antagonists described in PCT Publication WO 2017/156164. In some embodiments, the GPR75 inhibitor is an inhibitor of the interaction between GPR75 and 20-HETE is a blocking antibody.

In some embodiments, the methods of treatment further comprise detecting the absence of a GPR75 missense variant nucleic acid molecule encoding a predicted loss-of-function GPR75 polypeptide in a biological sample from the subject. As used throughout the present disclosure, a "GPR75 missense variant nucleic acid molecule" is any GPR75 nucleic acid molecule (such as, for example, genomic nucleic acid molecule, mRNA molecule, or cDNA molecule) encoding a GPR75 polypeptide having a partial loss-of-function, a complete loss-of-function, a predicted partial loss-of-function, or a predicted complete loss-of-function.

The present disclosure also provides methods of treating a subject with a therapeutic agent that treats or inhibits obesity, wherein the subject is obese. In some embodiments, the methods comprise determining whether the subject has a GPR75 missense variant nucleic acid molecule encoding a predicted loss-of-function GPR75 polypeptide by obtaining or having obtained a biological sample from the subject, and performing or having performed a sequence analysis on the biological sample to determine if the subject has a genotype comprising the GPR75 missense variant nucleic acid molecule. When the subject is GPR75 reference, the therapeutic agent that treats or inhibits obesity and/or a GPR75 inhibitor is administered or continued to be administered to the subject in a standard dosage amount. When the subject is heterozygous for a GPR75 missense variant nucleic acid molecule, the therapeutic agent that treats or inhibits obesity and/or a GPR75 inhibitor is administered or continued to be administered to the subject in an amount that is the same as or lower than a standard dosage amount. The presence of a genotype having the GPR75 missense variant nucleic acid molecule encoding a predicted loss-of-function GPR75 polypeptide indicates the subject has a reduced risk of developing obesity. In some embodiments, the subject is GPR75 reference. In some embodiments, the subject is heterozygous for a GPR75 missense variant nucleic acid molecule encoding a predicted loss-of-function GPR75 polypeptide.

For subjects that are genotyped or determined to be either GPR75 reference or heterozygous for a GPR75 missense variant nucleic acid molecule, such subjects can be treated with a GPR75 inhibitor, as described herein.

Detecting the presence or absence of a GPR75 missense variant nucleic acid molecule in a biological sample from a subject and/or determining whether a subject has a GPR75 missense variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, when the subject is GPR75 reference, the subject is also administered a therapeutic agent that treats or inhibits obesity and/or a GPR75 inhibitor in a standard dosage amount. In some embodiments, when the subject is heterozygous for a GPR75 missense variant nucleic acid molecule, the subject is also administered a therapeutic agent that treats or inhibits obesity and/or a GPR75 inhibitor in a dosage amount that is the same as or lower than a standard dosage amount.

In some embodiments, the treatment methods further comprise detecting the absence of a GPR75 predicted loss-of-function polypeptide in a biological sample from the subject. In some embodiments, when the subject does not have a GPR75 predicted loss-of-function polypeptide, the subject is also administered a therapeutic agent that treats or inhibits obesity and/or a GPR75 inhibitor in a standard dosage amount. In some embodiments, when the subject has a GPR75 predicted loss-of-function polypeptide, the subject is also administered a therapeutic agent that treats or inhibits obesity and/or a GPR75 inhibitor in a dosage amount that is the same as or lower than a standard dosage amount.

The present disclosure also provides methods of treating a subject with a therapeutic agent that treats or inhibits obesity, wherein the subject is obese. In some embodiments, the method comprises determining whether the subject has a GPR75 predicted loss-of-function polypeptide by obtaining or having obtained a biological sample from the subject, and performing or having performed an assay on the biological sample to determine if the subject has a GPR75 predicted loss-of-function polypeptide. When the subject does not have a GPR75 predicted loss-of-function polypeptide, the therapeutic agent that treats or inhibits obesity and/or a GPR75 inhibitor is administered or continued to be administered to the subject in a standard dosage amount. When the subject has a GPR75 predicted loss-of-function polypeptide, the therapeutic agent that treats or inhibits obesity and/or a GPR75 inhibitor is administered or continued to be administered to the subject in an amount that is the same as or lower than a standard dosage amount. The presence of a GPR75 predicted loss-of-function polypeptide indicates the subject has a reduced risk of developing obesity. In some embodiments, the subject has a GPR75 predicted loss-of-function polypeptide. In some embodiments, the subject does not have a GPR75 predicted loss-of-function polypeptide.

Detecting the presence or absence of a GPR75 predicted loss-of-function polypeptide in a biological sample from a subject and/or determining whether a subject has a GPR75 predicted loss-of-function polypeptide can be carried out by any of the methods described herein. In some embodiments, these methods can be carried out in vitro. In some embodiments, these methods can be carried out in situ. In some embodiments, these methods can be carried out in vivo. In any of these embodiments, the polypeptide can be present within a cell obtained from the subject.

Examples of therapeutic agents that treat or inhibit obesity and/or increased BMI include, but are not limited to, sibutramine, orlistat, phentermine, lorcaserin, naltrexone, liraglutide, diethylpropion, bupropion, metformin, pramlintide, topiramate, and zonisamide, or any combination thereof. Examples of therapeutic agents that treat or inhibit obesity and/or increased BMI also include, but are not limited to, sibutramine, orlistat, phentermine and topiramate, lorcaserin, bupropion and naltrexone, liraglutide, phentermine and diethylpropion, bupropion, metformin, pramlintide, topiramate, and zonisamide, or any combination thereof.

In some embodiments, the therapeutic agent that treats or inhibits obesity and/or increased BMI is a GLP1R agonist including, but not limited to, BYETTA® or BYDUREON® (exenatide), VICTOZA® or SAXENDA® (liraglutide), LYXUMIA® or ADLYXIN® (lixisenatide), TANZEUM® (albiglutide), TRULICITY® (dulaglutide), and OZEMPIC® (semaglutide), or any combination thereof. In some embodiments, the therapeutic agent that treats or inhibits obesity and/or increased BMI is BYETTA® (exenatide). In some embodiments, the therapeutic agent that treats or inhibits obesity and/or increased BMI is BYETTA® (exenatide). In some embodiments, the therapeutic agent that treats or inhibits obesity and/or increased BMI is VICTOZA® (liraglutide). In some embodiments, the therapeutic agent that treats or inhibits obesity and/or increased BMI is SAXENDA® (liraglutide). In some embodiments, the therapeutic agent that treats or inhibits obesity and/or increased BMI is LYXUMIA® (lixisenatide). In some embodiments, the therapeutic agent that treats or inhibits obesity and/or increased BMI is ADLYXIN® (lixisenatide). In some embodiments, the therapeutic agent that treats or inhibits obesity and/or increased BMI is TANZEUM® (albiglutide). In some embodiments, the therapeutic agent that treats or inhibits obesity and/or increased BMI is TRULICITY® (dulaglutide). In some embodiments, the therapeutic agent that treats or inhibits obesity and/or increased BMI is OZEMPIC® (semaglutide). In some embodiments, the therapeutic agent that treats or inhibits obesity and/or increased BMI is chosen from exenatide, liraglutide, lixisenatide, albiglutide, dulaglutide, and semaglutide, or any combination thereof. In some embodiments, the therapeutic agent that treats or inhibits obesity and/or increased BMI is exenatide. In some embodiments, the therapeutic agent that treats or inhibits obesity and/or increased BMI liraglutide. In some embodiments, the therapeutic agent that treats or inhibits obesity and/or increased BMI is lixisenatide. In some embodiments, the therapeutic agent that treats or inhibits obesity and/or increased BMI is albiglutide. In some embodiments, the therapeutic agent that treats or inhibits obesity and/or increased BMI is dulaglutide. In some embodiments, the therapeutic agent that treats or inhibits obesity and/or increased BMI is semaglutide.

In some embodiments, the therapeutic agent that treats or inhibits obesity and/or reduces BMI is a melanocortin 4 receptor (MC4R) agonist. In some embodiments, the MC4R agonist comprises a protein, a peptide, a nucleic acid molecule, or a small molecule. In some embodiments, the protein is a peptide analog of MC4R. In some embodiments, the peptide is setmelanotide. In some embodiments, the therapeutic agent that treats or inhibits obesity and/or reduces BMI is a combination of setmelanotide and one or more of sibutramine, orlistat, phentermine, lorcaserin, naltrexone, liraglutide, diethylpropion, bupropion, metformin, pramlintide, topiramate, and zonisamide. In some embodiments, the MC4R agonist is a peptide comprising the amino acid sequence His-Phe-Arg-Trp. In some embodiments, the small molecule is 1,2,3R,4-tetrahydroisoquinoline-3-carboxylic acid. In some embodiments, the MC4R agonist is ALB-127158(a).

In some embodiments, the dose of the therapeutic agents that treat or inhibit obesity and/or a GPR75 inhibitor can be reduced by about 10%, by about 20%, by about 30%, by about 40%, by about 50%, by about 60%, by about 70%, by about 80%, or by about 90% for subjects that are heterozygous for a GPR75 missense variant nucleic acid molecule (i.e., a lower than the standard dosage amount) compared to subjects that are GPR75 reference (who may receive a standard dosage amount). In some embodiments, the dose of the therapeutic agents that treat or inhibit obesity and/or a GPR75 inhibitor can be reduced by about 10%, by about 20%, by about 30%, by about 40%, or by about 50%. In addition, the dose of therapeutic agents that treat or inhibit obesity and/or a GPR75 inhibitor in subjects that are heterozygous for a GPR75 missense variant nucleic acid molecule can be administered less frequently compared to subjects that are GPR75 reference.

Administration of the therapeutic agents that treat or inhibit obesity and/or GPR75 inhibitors can be repeated, for example, after one day, two days, three days, five days, one week, two weeks, three weeks, one month, five weeks, six weeks, seven weeks, eight weeks, two months, or three months. The repeated administration can be at the same dose or at a different dose. The administration can be repeated once, twice, three times, four times, five times, six times, seven times, eight times, nine times, ten times, or more. For example, according to certain dosage regimens a subject can receive therapy for a prolonged period of time such as, for example, 6 months, 1 year, or more.

Administration of the therapeutic agents that treat or inhibit obesity and/or GPR75 inhibitors can occur by any suitable route including, but not limited to, parenteral, intravenous, oral, subcutaneous, intra-arterial, intracranial, intrathecal, intraperitoneal, topical, intranasal, or intramuscular. Pharmaceutical compositions for administration are desirably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

In some embodiments, the therapeutic agents that treat or inhibit obesity and/or GPR75 inhibitors (such as any of the inhibitory nucleic acid molecules disclosed herein) are administered intrathecally (i.e., introduction into the subarachnoid space of the spinal cord or into the spinal canal so that the therapeutic agent can reach the cerebrospinal fluid of a subject, or introduction into the anatomic space or potential space inside a sheath, including, by way of non-limiting examples, the arachnoid membrane of the brain or spinal cord). In some embodiments, intrathecal administration results in the therapeutic agent acting on, without limitation, the cortex, the cerebellum, the striatum, the cervical spine, the lumbar spine, or the thoracic spine. Therapeutic agents administered intrathecally may ultimately act on targets throughout the entire central nervous system. In some embodiments, the intrathecal administration is into the cisterna magna or by the lumbar area or region. In some embodiments, the intrathecal administration into the lumbar area or region results in delivery of the therapeutic agent to the distal spinal canal. Exemplary methods for intrathecal administration are described in, for example, Lazorthes et al., Advances in Drug Delivery Systems and Applications in Neurosurgery, 143-192. In some embodiments, the intrathecal administration is by injection, by bolus injection, by a catheter, or by a pump. In some embodiments, the intrathecal administration is by lumber puncture. In some embodiments, the pump is an osmotic pump. In some embodiments, the pump is implanted into subarachnoid space of the spinal canal, below the skin of the abdomen, or behind the chest wall. In some embodiments, the intrathecal administration is by an intrathecal delivery system for a therapeutic substance including a reservoir containing a volume of the therapeutic agent and a pump configured to deliver at least a portion of the therapeutic substance contained in the reservoir. In some embodiments, intrathecal administration is through intermittent or continuous access to an implanted intrathecal drug delivery device (IDDD). In some embodiments, the therapeutic substance is an inhibitory nucleic acid molecule. In some embodiments, the amount of the nucleic acid molecule administered intrathecally ranges from about 10 µg to about 2 mg, from about 50 µg to about 1500 µg, or from about 100 µg to about 1000 µg. In some embodiments, the therapeutic agent is disposed within a pharmaceutical composition. In some embodiments, the pharmaceutical composition does not comprise a preservative.

The terms "treat", "treating", and "treatment" and "prevent", "preventing", and "prevention" as used herein, refer to eliciting the desired biological response, such as a therapeutic and prophylactic effect, respectively. In some embodiments, a therapeutic effect comprises one or more of a decrease/reduction in obesity, a decrease/reduction in the severity of obesity (such as, for example, a reduction or inhibition of development or obesity), a decrease/reduction in symptoms and obesity-related effects, delaying the onset of symptoms and obesity-related effects, reducing the severity of symptoms of obesity-related effects, reducing the severity of an acute episode, reducing the number of symptoms and obesity-related effects, reducing the latency of symptoms and obesity-related effects, an amelioration of symptoms and obesity-related effects, reducing secondary symptoms, reducing secondary infections, preventing relapse to obesity, decreasing the number or frequency of relapse episodes, increasing latency between symptomatic episodes, increasing time to sustained progression, expediting remission, inducing remission, augmenting remission, speeding recovery, or increasing efficacy of or decreasing resistance to alternative therapeutics, and/or an increased survival time of the affected host animal, following administration of the agent or composition comprising the agent. A prophylactic effect may comprise a complete or partial avoidance/inhibition or a delay of obesity development/progression (such as, for example, a complete or partial avoidance/inhibition or a delay), or an increased survival time of the affected host animal, following administration of a therapeutic protocol. Treatment of obesity encompasses the treatment of subjects already diagnosed as having any form of obesity at any clinical stage or manifestation, the delay of the onset or evolution or aggravation or deterioration of the symptoms or signs of obesity, and/or preventing and/or reducing the severity of obesity.

The present disclosure also provides methods of identifying a subject having an increased risk for developing obesity, excessive weight, elevated BMI, elevated body fat mass, percentage, or volume, and/or excessive food intake. In some embodiments, the method comprises determining or having determined in a biological sample obtained from the subject the presence or absence of a GPR75 missense variant nucleic acid molecule (such as a genomic nucleic acid molecule, mRNA molecule, and/or cDNA molecule) encoding a predicted loss-of-function GPR75 polypeptide. When the subject lacks a GPR75 missense variant nucleic acid molecule (i.e., the subject is genotypically categorized as a GPR75 reference), then the subject has an increased risk for developing obesity. When the subject has a GPR75 missense variant nucleic acid molecule (i.e., the subject is heterozygous or homozygous for a GPR75 missense variant nucleic acid molecule), then the subject has a decreased risk for developing obesity.

Having a single copy of a GPR75 missense variant nucleic acid molecule is more protective of a subject from developing obesity than having no copies of a GPR75 missense variant nucleic acid molecule. Without intending to be limited to any particular theory or mechanism of action, it is believed that a single copy of a GPR75 missense variant nucleic acid molecule (i.e., heterozygous for a GPR75 missense variant nucleic acid molecule) is protective of a subject from developing obesity, and it is also believed that having two copies of a GPR75 missense variant nucleic acid molecule (i.e., homozygous for a GPR75 missense variant nucleic acid molecule) may be more protective of a subject from developing obesity, relative to a subject with a single copy. Thus, in some embodiments, a single copy of a GPR75 missense variant nucleic acid molecule may not be completely protective, but instead, may be partially or incompletely protective of a subject from developing obesity. While not desiring to be bound by any particular theory, there may be additional factors or molecules involved in the development of obesity that are still present in a subject having a single copy of a GPR75 missense variant nucleic acid molecule, thus resulting in less than complete protection from the development of obesity.

Determining whether a subject has a GPR75 missense variant nucleic acid molecule in a biological sample from a subject and/or determining whether a subject has a GPR75 missense variant nucleic acid molecule can be carried out by any of the methods described herein. In some embodiments, these methods can be carried out in vitro. In some embodiments, these methods can be carried out in situ. In some embodiments, these methods can be carried out in vivo. In any of these embodiments, the nucleic acid molecule can be present within a cell obtained from the subject.

In some embodiments, when a subject is identified as having an increased risk of developing obesity, the subject is further treated with a therapeutic agent that treats or inhibits obesity and/or a GPR75 inhibitor, as described herein. For example, when the subject is GPR75 reference, and therefore has an increased risk for developing obesity, the subject is administered a GPR75 inhibitor. In some embodiments, such a subject is also administered a therapeutic agent that treats or inhibits obesity. In some embodiments, when the subject is heterozygous for a GPR75 missense variant nucleic acid molecule, the subject is administered the therapeutic agent that treats or inhibits obesity and/or a GPR75 inhibitor in a dosage amount that is the same as or lower than a standard dosage amount. In some embodiments, the subject is GPR75 reference. In some embodiments, the subject is heterozygous for a GPR75 missense variant nucleic acid molecule.

The present disclosure also provides methods of detecting the presence or absence of a GPR75 missense genomic variant nucleic acid molecule in a biological sample from a subject, and/or a GPR75 missense variant mRNA molecule in a biological sample from a subject, and/or a GPR75 missense variant cDNA molecule produced from an mRNA molecule in a biological sample from a subject. It is understood that gene sequences within a population and mRNA molecules encoded by such genes can vary due to polymorphisms such as single-nucleotide polymorphisms. The sequences provided herein for the GPR75 variant genomic nucleic acid molecule, GPR75 variant mRNA molecule, and GPR75 variant cDNA molecule are only exemplary sequences. Other sequences for the GPR75 variant genomic nucleic acid molecule, variant mRNA molecule, and variant cDNA molecule are also possible.

The biological sample can be derived from any cell, tissue, or biological fluid from the subject. The biological sample may comprise any clinically relevant tissue, such as a bone marrow sample, a tumor biopsy, a fine needle aspirate, or a sample of bodily fluid, such as blood, gingival crevicular fluid, plasma, serum, lymph, ascitic fluid, cystic fluid, or urine. In some cases, the sample comprises a buccal swab. The biological sample used in the methods disclosed herein can vary based on the assay format, nature of the detection method, and the tissues, cells, or extracts that are used as the sample. A biological sample can be processed differently depending on the assay being employed. For example, when detecting any GPR75 variant nucleic acid molecule, preliminary processing designed to isolate or enrich the biological sample for the genomic DNA can be employed. A variety of techniques may be used for this purpose. When detecting the level of any GPR75 variant mRNA molecule, different techniques can be used enrich the biological sample with mRNA molecules. Various methods to detect the presence or level of an mRNA molecule or the presence of a particular variant genomic DNA locus can be used.

In some embodiments, detecting a human GPR75 missense variant nucleic acid molecule in a subject comprises assaying or genotyping a biological sample obtained from the subject to determine whether a GPR75 genomic nucleic acid molecule in the biological sample, and/or a GPR75 mRNA molecule in the biological sample, and/or a GPR75 cDNA molecule produced from an mRNA molecule in the biological sample, comprises one or more variations that cause a loss-of-function (partial or complete) or are predicted to cause a loss-of-function (partial or complete).

In some embodiments, the methods of detecting the presence or absence of a GPR75 missense variant nucleic acid molecule (such as, for example, a genomic nucleic acid molecule, an mRNA molecule, and/or a cDNA molecule produced from an mRNA molecule) in a subject, comprise performing an assay on a biological sample obtained from the subject. The assay determines whether a nucleic acid molecule in the biological sample comprises a particular nucleotide sequence.

In some embodiments, the nucleotide sequence: lacks a CCAGTAG heptanucleotide at positions corresponding to positions 5,540-5,546 according to SEQ ID NO:1 (for genomic nucleic acid molecules); lacks a CCAGUAG heptanucleotide at positions corresponding to positions 539-545 according to SEQ ID NO:7, lacks a CCAGUAG heptanucleotide at positions corresponding to positions 440-446 according to SEQ ID NO:8, lacks a CCAGUAG heptanucleotide at positions corresponding to positions 361-367 according to SEQ ID NO:9, or lacks a CCAGUAG heptanucleotide at positions corresponding to positions 600-606 according to SEQ ID NO:10 (for mRNA molecules); lacks a CCAGTAG heptanucleotide at positions corresponding to positions 539-545 according to SEQ ID NO:31, lacks a CCAGTAG heptanucleotide at positions corresponding to positions 440-446 according to SEQ ID NO:32, lacks a CCAGTAG heptanucleotide at positions corresponding to positions 361-367 according to SEQ ID NO:33, or lacks a CCAGTAG heptanucleotide at positions corresponding to positions 600-606 according to SEQ ID NO:34 (for cDNA molecules).

In some embodiments, the nucleotide sequence comprises: an adenine at a position corresponding to position 5,557 according to SEQ ID NO:3 (for genomic nucleic acid molecules); an adenine at a position corresponding to position 556 according to SEQ ID NO:12, an adenine at a position corresponding to position 457 according to SEQ ID NO:17, an adenine at a position corresponding to position 378 according to SEQ ID NO:22, or an adenine at a position corresponding to position 617 according to SEQ ID NO:27 (for mRNA molecules); an adenine at a position corresponding to position 556 according to SEQ ID NO:36, an adenine at a position corresponding to position 457 according to SEQ ID NO:41, an adenine at a position corresponding to position 378 according to SEQ ID NO:46, or an adenine at a position corresponding to position 617 according to SEQ ID NO:51 (for cDNA molecules).

In some embodiments, the nucleotide sequence comprises: a thymine at a position corresponding to position 5,911 according to SEQ ID NO:4 (for genomic nucleic acid molecules); a uracil at a position corresponding to position 910 according to SEQ ID NO:13, a uracil at a position corresponding to position 811 according to SEQ ID NO:18, a uracil at a position corresponding to position 732 according to SEQ ID NO:23, or a uracil at a position corresponding to position 971 according to SEQ ID NO:28 (for mRNA molecules); a thymine at a position corresponding to position 910 according to SEQ ID NO:37, a thymine at a position corresponding to position 811 according to SEQ ID NO:42, a thymine at a position corresponding to position 732 according to SEQ ID NO:47, or a thymine at a position corresponding to position 971 according to SEQ ID NO:52 (for cDNA molecules).

In some embodiments, the nucleotide sequence: lacks an AAAG tetranucleotide at positions corresponding to positions 5,920-5,923 according to SEQ ID NO:1 (for genomic nucleic acid molecules); lacks an AAAG tetranucleotide at positions corresponding to positions 919-922 according to SEQ ID NO:7, lacks an AAAG tetranucleotide at positions corresponding to positions 820-823 according to SEQ ID NO:8, lacks an AAAG tetranucleotide at positions corresponding to positions 741-744 according to SEQ ID NO:9, or lacks an AAAG tetranucleotide at positions corresponding to positions 980-983 according to SEQ ID NO:10 (for mRNA molecules); lacks an AAAG tetranucleotide at positions corresponding to positions 919-922 according to SEQ ID NO:31, lacks an AAAG tetranucleotide at positions corresponding to positions 820-823 according to SEQ ID NO:32, lacks an AAAG tetranucleotide at positions corresponding to positions 741-744 according to SEQ ID NO:33, or lacks an AAAG tetranucleotide at positions corresponding to positions 980-983 according to SEQ ID NO:34 (for cDNA molecules).

In some embodiments, the nucleotide sequence comprises: an insertion of a thymine at a position corresponding to position 6,411 according to SEQ ID NO:6 (for genomic nucleic acid molecules); an insertion of a uracil at a position corresponding to position 1,410 according to SEQ ID NO:15, an insertion of a uracil at a position corresponding to position 1,311 according to SEQ ID NO:20, an insertion of a uracil at a position corresponding to position 1,232 according to SEQ ID NO:25, or an insertion of a uracil at a position corresponding to position 1,471 according to SEQ ID NO:30 (for mRNA molecules); an insertion of a thymine at a position corresponding to position 1,410 according to SEQ ID NO:39, an insertion of a thymine at a position corresponding to position 1,311 according to SEQ ID NO:44, an insertion of a thymine at a position corresponding to position 1,232 according to SEQ ID NO:49, or an insertion of a thymine at a position corresponding to position 1,471 according to SEQ ID NO:54 (for cDNA molecules).

In some embodiments, the nucleotide sequence comprises: a guanine at a position corresponding to position 5,831 according to SEQ ID NO:99, or the complement thereof (for genomic nucleic acid molecules); a guanine at a position corresponding to position 830 according to SEQ ID NO:100, or the complement thereof; a guanine at a position corresponding to position 731 according to SEQ ID NO:101, or the complement thereof; a guanine at a position corresponding to position 652 according to SEQ ID NO:102, or the complement thereof; or a guanine at a position corresponding to position 891 according to SEQ ID NO:103, or the complement thereof (for mRNA molecules); a guanine at a position corresponding to position 830 according to SEQ ID NO:104, or the complement thereof; a guanine at a position corresponding to position 731 according to SEQ ID NO:105, or the complement thereof; a guanine at a position corresponding to position 652 according to SEQ ID NO:106, or the complement thereof; or a guanine at a position corresponding to position 891 according to SEQ ID NO:107, or the complement thereof (for cDNA molecules).

In some embodiments, the nucleotide sequence: lacks a CCAGTAG heptanucleotide at positions corresponding to positions 5,540-5,546 according to SEQ ID NO:1, or the complement thereof; comprises an adenine at a position corresponding to position 5,557 according to SEQ ID NO:3, or the complement thereof; comprises a thymine at a position corresponding to position 5,911 according to SEQ ID NO:4, or the complement thereof; lacks an AAAG tetranucleotide at positions corresponding to positions 5,920-5,923 according to SEQ ID NO:1, or the complement thereof; comprises an insertion of a thymine at a position corresponding to position 6,411 according to SEQ ID NO:6, or the complement thereof; or comprises a guanine at a position corresponding to position 5,831 according to SEQ ID NO:99, or the complement thereof.

In some embodiments, the nucleotide sequence: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; comprises an adenine at a position corresponding to position 556 according to SEQ ID NO:12, or the complement thereof; comprises an adenine at a position corresponding to position 457 according to SEQ ID NO:17, or the complement thereof; comprises an adenine at a position corresponding to position 378 according to SEQ ID NO:22, or the complement thereof; comprises an adenine at a position corresponding to position 617 according to SEQ ID NO:27, or the complement thereof; comprises a uracil at a position corresponding to position 910 according to SEQ ID NO:13, or the complement thereof; comprises a uracil at a position corresponding to position 811 according to SEQ ID NO:18, or the complement thereof; comprises a uracil at a position corresponding to position 732 according to SEQ ID NO:23, or the complement thereof; comprises a uracil at a position corresponding to position 971 according to SEQ ID NO:28, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; comprises an insertion of a uracil at a position corresponding to position 1,471 according to SEQ ID NO:30, or the complement thereof; comprises a guanine at a position corresponding to position 830 according to SEQ ID NO:100, or the complement thereof; comprises a guanine at a position corresponding to position 731 according to SEQ ID NO:101, or the complement thereof; comprises a guanine at a position corresponding to position 652 according to SEQ ID NO:102, or the complement thereof; or comprises a guanine at a position corresponding to position 891 according to SEQ ID NO:103, or the complement thereof.

In some embodiments, the nucleotide sequence: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; comprises an adenine at a position corresponding to position 556 according to SEQ ID NO:36, or the complement thereof; comprises an adenine at a position corresponding to position 457 according to SEQ ID NO:41, or the complement thereof; comprises an adenine at a position corresponding to position 378 according to SEQ ID NO:46, or the complement thereof; comprises an adenine at a position corresponding to position 617 according to SEQ ID NO:51, or the complement thereof; comprises a thymine at a position corresponding to position 910 according to SEQ ID NO:37, or the complement thereof; comprises a thymine at a position corresponding to position 811 according to SEQ ID NO:42, or the complement thereof; comprises a thymine at a position corresponding to position 732 according to SEQ ID NO:47, or the complement thereof; comprises a thymine at a position corresponding to position 971 according to SEQ ID NO:52, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, or the complement thereof; comprises an insertion of a thymine at a position corresponding to position 1,471 according to SEQ ID NO:54, or the complement thereof; comprises a guanine at a position corresponding to position 830 according to SEQ ID NO:104, or the complement thereof; comprises a guanine at a position corresponding to position 731 according to SEQ ID NO:105, or the complement thereof; comprises a guanine at a position corresponding to position 652 according to SEQ ID NO:106, or the complement thereof; or comprises a guanine at a position corresponding to position 891 according to SEQ ID NO:107, or the complement thereof.

In some embodiments, the biological sample comprises a cell or cell lysate. Such methods can further comprise, for example, obtaining a biological sample from the subject comprising a GPR75 genomic nucleic acid molecule or mRNA molecule, and if mRNA, optionally reverse transcribing the mRNA into cDNA. Such assays can comprise, for example determining the identity of these positions of the particular GPR75 nucleic acid molecule. In some embodiments, the method is an in vitro method.

In some embodiments, the determining step, detecting step, or sequence analysis comprises sequencing at least a portion of the nucleotide sequence of the GPR75 genomic nucleic acid molecule, the GPR75 mRNA molecule, or the GPR75 cDNA molecule in the biological sample, wherein the sequenced portion comprises one or more variations that cause a loss-of-function (partial or complete) or are predicted to cause a loss-of-function (partial or complete).

In some embodiments, the determining step, detecting step, or sequence analysis comprises sequencing at least a portion of: i) the nucleotide sequence of the GPR75 genomic nucleic acid molecule in the biological sample, wherein the sequenced portion comprises a position corresponding to positions 5,540-5,546 according to SEQ ID NO:2, or the complement thereof; ii) the nucleotide sequence of the GPR75 mRNA molecule in the biological sample, wherein the sequenced portion comprises a position corresponding to: positions 539-545 according to SEQ ID NO:11, or the complement thereof; positions 440-446 according to SEQ ID NO:16, or the complement thereof; positions 361-367 according to SEQ ID NO:21, or the complement thereof; or positions 600-606 according to SEQ ID NO:26, or the complement thereof; and/or iii) the nucleotide sequence of the GPR75 cDNA molecule produced from the mRNA in the biological sample, wherein the sequenced portion comprises a position corresponding to: positions 539-545 according to SEQ ID NO:35, or the complement thereof; positions 440-446 according to SEQ ID NO:40, or the complement thereof; positions 361-367 according to SEQ ID NO:45, or the complement thereof; or positions 600-606 according to SEQ ID NO:50, or the complement thereof. When the sequenced portion of the GPR75 nucleic acid molecule in the biological sample comprises: i) a deletion of a CCAGTAG heptanucleotide at positions corresponding to positions 5,540-5,546 according to SEQ ID NO:1; ii) a deletion of a CCAGUAG heptanucleotide at positions corresponding to positions 539-545 according to SEQ ID NO:7, a deletion of a CCAGUAG heptanucleotide at positions corresponding to positions 440-446 according to SEQ ID NO:8, a deletion of a CCAGUAG heptanucleotide at positions corresponding to positions 361-367 according to SEQ ID NO:9, or a deletion of a CCAGUAG heptanucleotide at positions corresponding to positions 600-606 according to SEQ ID NO:10; or iii) a deletion of a CCAGTAG heptanucleotide at positions corresponding to positions 539-545 according to SEQ ID NO:31, a deletion of a CCAGTAG heptanucleotide at positions corresponding to positions 440-446 according to SEQ ID NO:32, a deletion of a CCAGTAG heptanucleotide at positions corresponding to positions 361-367 according to SEQ ID NO:33, or a deletion of a CCAGTAG heptanucleotide at positions corresponding to positions 600-606 according to SEQ ID NO:34, then the GPR75 nucleic acid molecule in the biological sample is a GPR75 missense variant nucleic acid molecule.

In some embodiments, the determining step, detecting step, or sequence analysis comprises sequencing at least a portion of: i) the nucleotide sequence of the GPR75 genomic nucleic acid molecule in the biological sample, wherein the sequenced portion comprises a position corresponding to position 5,557 according to SEQ ID NO:3, or the complement thereof; ii) the nucleotide sequence of the GPR75 mRNA molecule in the biological sample, wherein the sequenced portion comprises a position corresponding to: position 556 according to SEQ ID NO:12, or the complement thereof; position 457 according to SEQ ID NO:17, or the complement thereof; position 378 according to SEQ ID NO:22, or the complement thereof; or position 617 according to SEQ ID NO:27, or the complement thereof; and/or iii) the nucleotide sequence of the GPR75 cDNA molecule produced from the mRNA in the biological sample, wherein the sequenced portion comprises a position corresponding to: position 556 according to SEQ ID NO:36, or the complement thereof; position 457 according to SEQ ID NO:41, or the complement thereof; position 378 according to SEQ ID NO:46, or the complement thereof; or position 617 according to SEQ ID NO:51, or the complement thereof. When the sequenced portion of the GPR75 nucleic acid molecule in the biological sample comprises: i) an adenine at a position corresponding to position 5,557 according to SEQ ID NO:3; ii) an adenine at a position corresponding to position 556 according to SEQ ID NO:12, an adenine at a position corresponding to position 457 according to SEQ ID NO:17, an adenine at a position corresponding to position 378 according to SEQ ID NO:22, or an adenine at a position corresponding to position 617 according to SEQ ID NO:27; or iii) an adenine at a position corresponding to position 556 according to SEQ ID NO:36, an adenine at a position corresponding to position 457 according to SEQ ID NO:41, an adenine at a position corresponding to position 378 according to SEQ ID NO:46, or an adenine at a position corresponding to position 617 according to SEQ ID NO:51, then the GPR75 nucleic acid molecule in the biological sample is a GPR75 missense variant nucleic acid molecule.

In some embodiments, the determining step, detecting step, or sequence analysis comprises sequencing at least a portion of: i) the nucleotide sequence of the GPR75 genomic nucleic acid molecule in the biological sample, wherein the sequenced portion comprises a position corresponding to position 5,911 according to SEQ ID NO:4, or the complement thereof; ii) the nucleotide sequence of the GPR75 mRNA molecule in the biological sample, wherein the sequenced portion comprises a position corresponding to: position 910 according to SEQ ID NO:13, or the complement thereof; position 811 according to SEQ ID NO:18, or the complement thereof; position 732 according to SEQ ID NO:23, or the complement thereof; or position 971 according to SEQ ID NO:28, or the complement thereof; and/or iii) the nucleotide sequence of the GPR75 cDNA molecule produced from the mRNA in the biological sample, wherein the sequenced portion comprises a position corresponding to: position 910 according to SEQ ID NO:37, or the complement thereof; position 811 according to SEQ ID NO:42, or the complement thereof; position 732 according to SEQ ID NO:47, or the complement thereof; or position 971 according to SEQ ID NO:52, or the complement thereof. When the sequenced portion of the GPR75 nucleic acid molecule in the biological sample comprises: i) a thymine at a position corresponding to position 5,911 according to SEQ ID NO:4; ii) a uracil at a position corresponding to position 910 according to SEQ ID NO:13, a uracil at a position corresponding to position 811 according to SEQ ID NO:18, a uracil at a position corresponding to position 732 according to SEQ ID NO:23, or a uracil at a position corresponding to position 971 according to SEQ ID NO:28; or iii) a thymine at a position corresponding to position 910 according to SEQ ID NO:37, a thymine at a position corresponding to position 811 according to SEQ ID NO:42, a thymine at a position corresponding to position 732 according to SEQ ID NO:47, or a thymine at a position corresponding to position 971 according to SEQ ID NO:52, then the GPR75 nucleic acid molecule in the biological sample is a GPR75 missense variant nucleic acid molecule.

In some embodiments, the determining step, detecting step, or sequence analysis comprises sequencing at least a portion of: i) the nucleotide sequence of the GPR75 genomic nucleic acid molecule in the biological sample, wherein the sequenced portion comprises a position corresponding to positions 5,920-5,923 according to SEQ ID NO:5, or the complement thereof; ii) the nucleotide sequence of the GPR75 mRNA molecule in the biological sample, wherein the sequenced portion comprises a position corresponding to: positions 919-922 according to SEQ ID NO:14, or the complement thereof; positions 820-823 according to SEQ ID NO:19, or the complement thereof; positions 741-744 according to SEQ ID NO:24, or the complement thereof; or positions 980-983 according to SEQ ID NO:29, or the complement thereof; and/or iii) the nucleotide sequence of the GPR75 cDNA molecule produced from the mRNA in the biological sample, wherein the sequenced portion comprises a position corresponding to: positions 919-922 according to SEQ ID NO:38, or the complement thereof; positions 820-823 according to SEQ ID NO:43, or the complement thereof; positions 741-744 according to SEQ ID NO:48, or the complement thereof; or positions 980-983 according to SEQ ID NO:53, or the complement thereof. When the sequenced portion of the GPR75 nucleic acid molecule in the biological sample comprises: i) a deletion of an AAAG tetranucleotide at positions corresponding to positions 5,920-5,923 according to SEQ ID NO:1; ii) a deletion of an AAAG tetranucleotide at positions corresponding to positions 919-922 according to SEQ ID NO:7, a deletion of an AAAG tetranucleotide at positions corresponding to positions 820-823 according to SEQ ID NO:8, a deletion of an AAAG tetranucleotide at positions corresponding to positions 741-744 according to SEQ ID NO:9, or a deletion of an AAAG tetranucleotide at positions corresponding to positions 980-983 according to SEQ ID NO:10; or iii) a deletion of an AAAG tetranucleotide at positions corresponding to positions 919-922 according to SEQ ID NO:31, a deletion of an AAAG tetranucleotide at positions corresponding to positions 820-823 according to SEQ ID NO:32, a deletion of an AAAG tetranucleotide at positions corresponding to positions 741-744 according to SEQ ID NO:33, or a deletion of an AAAG tetranucleotide at positions corresponding to positions 980-983 according to SEQ ID NO:34, then the GPR75 nucleic acid molecule in the biological sample is a GPR75 missense variant nucleic acid molecule.

In some embodiments, the determining step, detecting step, or sequence analysis comprises sequencing at least a portion of: i) the nucleotide sequence of the GPR75 genomic nucleic acid molecule in the biological sample, wherein the sequenced portion comprises a position corresponding to position 6,411 according to SEQ ID NO:6, or the complement thereof; ii) the nucleotide sequence of the GPR75 mRNA molecule in the biological sample, wherein the sequenced portion comprises a position corresponding to: position 1,410 according to SEQ ID NO:15, or the complement thereof; position 1,311 according to SEQ ID NO:20, or the complement thereof; position 1,232 according to SEQ ID NO:25, or the complement thereof; or position 1,471 according to SEQ ID NO:30 or the complement thereof; and/or iii) the nucleotide sequence of the GPR75 cDNA molecule produced from the mRNA in the biological sample, wherein the sequenced portion comprises a position corresponding to: position 1,410 according to SEQ ID NO:39, or the complement thereof; position 1,311 according to SEQ ID NO:44, or the complement thereof; position 1,232 according to SEQ ID NO:49, or the complement thereof; or position 1,471 according to SEQ ID NO:54, or the complement thereof. When the sequenced portion of the GPR75 nucleic acid molecule in the biological sample comprises: i) an insertion of a thymine at a position corresponding to position 6,411 according to SEQ ID NO:6; ii) an insertion of a uracil at a position corresponding to position 1,410 according to SEQ ID NO:15, an insertion of a uracil at a position corresponding to position 1,311 according to SEQ ID NO:20, an insertion of a uracil at a position corresponding to position 1,232 according to SEQ ID NO:25, or an insertion of a uracil at a position corresponding to position 1,471 according to SEQ ID NO:30; or iii) an insertion of a thymine at a position corresponding to position 1,410 according to SEQ ID NO:39, an insertion of a thymine at a position corresponding to position 1,311 according to SEQ ID NO:44, an insertion of a thymine at a position corresponding to position 1,232 according to SEQ ID NO:49, or an insertion of a thymine at a position corresponding to position 1,471 according to SEQ ID NO:54, then the GPR75 nucleic acid molecule in the biological sample is a GPR75 missense variant nucleic acid molecule.

In some embodiments, the determining step, detecting step, or sequence analysis comprises sequencing at least a portion of: i) the nucleotide sequence of the GPR75 genomic nucleic acid molecule in the biological sample, wherein the sequenced portion comprises a position corresponding to position 5,831 according to SEQ ID NO:99, or the complement thereof; ii) the nucleotide sequence of the GPR75 mRNA molecule in the biological sample, wherein the sequenced portion comprises a position corresponding to: position 830 according to SEQ ID NO:100, or the complement thereof; position 731 according to SEQ ID NO:101, or the complement thereof; position 652 according to SEQ ID NO:102, or the complement thereof; or position 891 according to SEQ ID NO:103, or the complement thereof; and/or iii) the nucleotide sequence of the GPR75 cDNA molecule produced from the mRNA in the biological sample, wherein the sequenced portion comprises a position corresponding to: position 830 according to SEQ ID NO:104, or the complement thereof; position 731 according to SEQ ID NO:105, or the complement thereof; position 652 according to SEQ ID NO:106, or the complement thereof; or position 891 according to SEQ ID NO:107, or the complement thereof. When the sequenced portion of the GPR75 nucleic acid molecule in the biological sample comprises: i) a guanine at a position corresponding to position 5,831 according to SEQ ID NO:99; ii) a guanine at a position corresponding to position 830 according to SEQ ID NO:100, a guanine at a position corresponding to position 731 according to SEQ ID NO:101, a guanine at a position corresponding to position 652 according to SEQ ID NO:102, or a guanine at a position corresponding to position 891 according to SEQ ID NO:103; or iii) a guanine at a position corresponding to position 830 according to SEQ ID NO:104, a guanine at a position corresponding to position 731 according to SEQ ID NO:105, a guanine at a position corresponding to position 652 according to SEQ ID NO:106, or a guanine at a position corresponding to position 891 according to SEQ ID NO:107, then the GPR75 nucleic acid molecule in the biological sample is a GPR75 missense variant nucleic acid molecule.

In some embodiments, the determining step, detecting step, or sequence analysis comprises sequencing at least a portion of the nucleotide sequence of the GPR75 genomic nucleic acid molecule in the biological sample, wherein the sequenced portion comprises a position corresponding to: positions 5,540-5,546 according to SEQ ID NO:2, or the complement thereof; position 5,557 according to SEQ ID NO:3, or the complement thereof; position 5,911 according to SEQ ID NO:4, or the complement thereof; positions 5,920-5,923 according to SEQ ID NO:5, or the complement thereof; position 6,411 according to SEQ ID NO:6, or the complement thereof; or position 5,831 according to SEQ ID NO:99, or the complement thereof. When the sequenced portion of the GPR75 nucleic acid molecule in the biological sample comprises: a deletion of a CCAGTAG heptanucleotide at positions corresponding to positions 5,540-5,546 according to SEQ ID NO:1, an adenine at a position corresponding to position 5,557 according to SEQ ID NO:3, a thymine at a position corresponding to position 5,911 according to SEQ ID NO:4, a deletion of an AAAG tetranucleotide at positions corresponding to positions 5,920-5,923 according to SEQ ID NO:1, an insertion of a thymine at a position corresponding to position 6,411 according to SEQ ID NO:6, or a guanine at a position corresponding to position 5,831 according to SEQ ID NO:99, then the GPR75 nucleic acid molecule in the biological sample is a GPR75 missense variant nucleic acid molecule.

In some embodiments, the determining step, detecting step, or sequence analysis comprises sequencing at least a portion of the nucleotide sequence of the GPR75 mRNA molecule in the biological sample, wherein the sequenced portion comprises a position corresponding to: positions 539-545 according to SEQ ID NO:11, or the complement thereof; positions 440-446 according to SEQ ID NO:16, or the complement thereof; positions 361-367 according to SEQ ID NO:21, or the complement thereof; positions 600-606 according to SEQ ID NO:26, or the complement thereof; position 556 according to SEQ ID NO:12, or the complement thereof; position 457 according to SEQ ID NO:17, or the complement thereof; position 378 according to SEQ ID NO:22, or the complement thereof; position 617 according to SEQ ID NO:27, or the complement thereof; position 910 according to SEQ ID NO:13, or the complement thereof; position 811 according to SEQ ID NO:18, or the complement thereof; position 732 according to SEQ ID NO:23, or the complement thereof; position 971 according to SEQ ID NO:28, or the complement thereof; positions 919-922 according to SEQ ID NO:14, or the complement thereof; positions 820-823 according to SEQ ID NO:19, or the complement thereof; positions 741-744 according to SEQ ID NO:24, or the complement thereof; positions 980-983 according to SEQ ID NO:29, or the complement thereof; position 1,410 according to SEQ ID NO:15, or the complement thereof; position 1,311 according to SEQ ID NO:20, or the complement thereof; position 1,232 according to SEQ ID NO:25, or the complement thereof; position 1,471 according to SEQ ID NO:30, or the complement thereof; position 830 according to SEQ ID NO:100, or the complement thereof; position 731 according to SEQ ID NO:101, or the complement thereof; position 652 according to SEQ ID NO:102, or the complement thereof; position 891 according to SEQ ID NO:103, or the complement thereof. When the sequenced portion of the GPR75 nucleic acid molecule in the biological sample: lacks a CCAGUAG heptanucleotide at positions corresponding to positions 539-545 according to SEQ ID NO:7; lacks a CCAGUAG heptanucleotide at positions corresponding to positions 440-446 according to SEQ ID NO:8; lacks a CCAGUAG heptanucleotide at positions corresponding to positions 361-367 according to SEQ ID NO:9; lacks a CCAGUAG heptanucleotide at positions corresponding to positions 600-606 according to SEQ ID NO:10; comprises an adenine at a position corresponding to position 556 according to SEQ ID NO:12; comprises an adenine at a position corresponding to position 457 according to SEQ ID NO:17; comprises an adenine at a position corresponding to position 378 according to SEQ ID NO:22; comprises an adenine at a position corresponding to position 617 according to SEQ ID NO:27; comprises a uracil at a position corresponding to position 910 according to SEQ ID NO:13; comprises a uracil at a position corresponding to position 811 according to SEQ ID NO:18; comprises a uracil at a position corresponding to position 732 according to SEQ ID NO:23; comprises a uracil at a position corresponding to position 971 according to SEQ ID NO:28; lacks an AAAG tetranucleotide at positions corresponding to positions 919-922 according to SEQ ID NO:7; lacks an AAAG tetranucleotide at positions corresponding to positions 820-823 according to SEQ ID NO:8; lacks an AAAG tetranucleotide at positions corresponding to positions 741-744 according to SEQ ID NO:9; lacks an AAAG tetranucleotide at positions corresponding to positions 980-983 according to SEQ ID NO:10; comprises an insertion of a uracil at a position corresponding to position 1,410 according to SEQ ID NO:15; comprises an insertion of a uracil at a position corresponding to position 1,311 according to SEQ ID NO:20; comprises an insertion of a uracil at a position corresponding to position 1,232 according to SEQ ID NO:25; comprises an insertion of a uracil at a position corresponding to position 1,471 according to SEQ ID NO:30; comprises a guanine at a position corresponding to position 830 according to SEQ ID NO:100; comprises a guanine at a position corresponding to position 731 according to SEQ ID NO:101; comprises a guanine at a position corresponding to position 652 according to SEQ ID NO:102; or comprises a guanine at a position corresponding to position 891 according to SEQ ID NO:103, then the GPR75 nucleic acid molecule in the biological sample is a GPR75 missense variant nucleic acid molecule.

In some embodiments, the determining step, detecting step, or sequence analysis comprises sequencing at least a portion of the nucleotide sequence of the GPR75 cDNA molecule produced from the mRNA molecule in the biological sample, wherein the sequenced portion comprises a position corresponding to: positions 539-545 according to SEQ ID NO:35, or the complement thereof; positions 440-446 according to SEQ ID NO:40, or the complement thereof; positions 361-367 according to SEQ ID NO:45, or the complement thereof; positions 600-606 according to SEQ ID NO:50, or the complement thereof; position 556 according to SEQ ID NO:36, or the complement thereof; position 457 according to SEQ ID NO:41, or the complement thereof; position 378 according to SEQ ID NO:46, or the complement thereof; position 617 according to SEQ ID NO:51, or the complement thereof; position 910 according to SEQ ID NO:37, or the complement thereof; position 811 according to SEQ ID NO:42, or the complement thereof; position 732 according to SEQ ID NO:47, or the complement thereof; position 971 according to SEQ ID NO:52, or the complement thereof; positions 919-922 according to SEQ ID NO:38, or the complement thereof; positions 820-823 according to SEQ ID NO:43, or the complement thereof; positions 741-744 according to SEQ ID NO:48, or the complement thereof; positions 980-983 according to SEQ ID NO:53, or the complement thereof; position 1,410 according to SEQ ID NO:39, or the complement thereof; position 1,311 according to SEQ ID NO:44, or the complement thereof; position 1,232 according to SEQ ID NO:49, the complement thereof; position 1,471 according to SEQ ID NO:54, or the complement thereof; position 830 according to SEQ ID NO:104, or the complement thereof; position 731 according to SEQ ID NO:105, or the complement thereof; position 652 according to SEQ ID NO:106, or the complement thereof; or position 891 according to SEQ ID NO:107, or the complement thereof. When the sequenced portion of the GPR75 nucleic acid molecule in the biological sample: lacks a CCAGTAG heptanucleotide at positions corresponding to positions 539-545 according to SEQ ID NO:31; lacks a CCAGTAG heptanucleotide at positions corresponding to positions 440-446 according to SEQ ID NO:32; lacks a CCAGTAG heptanucleotide at positions corresponding to positions 361-367 according to SEQ ID NO:33; lacks a CCAGTAG heptanucleotide at positions corresponding to positions 600-606 according to SEQ ID NO:34; comprises an adenine at a position corresponding to position 556 according to SEQ ID NO:36; comprises an adenine at a position corresponding to position 457 according to SEQ ID NO:41; comprises an adenine at a position corresponding to position 378 according to SEQ ID NO:46; comprises an adenine at a position corresponding to position 617 according to SEQ ID NO:51; comprises a thymine at a position corresponding to position 910 according to SEQ ID NO:37; comprises a thymine at a position corresponding to position 811 according to SEQ ID NO:42; a comprises thymine at a position corresponding to position 732 according to SEQ ID NO:47; comprises a thymine at a position corresponding to position 971 according to SEQ ID NO:52; lacks an AAAG tetranucleotide at positions corresponding to positions 919-922 according to SEQ ID NO:31; lacks an AAAG tetranucleotide at positions corresponding to positions 820-823 according to SEQ ID NO:32; lacks an AAAG tetranucleotide at positions corresponding to positions 741-744 according to SEQ ID NO:33; lacks an AAAG tetranucleotide at positions corresponding to positions 980-983 according to SEQ ID NO:34; comprises an insertion of a thymine at a position corresponding to position 1,410 according to SEQ ID NO:39; comprises an insertion of a thymine at a position corresponding to position 1,311 according to SEQ ID NO:44; comprises an insertion of a thymine at a position corresponding to position 1,232 according to SEQ ID NO:49; comprises an insertion of a thymine at a position corresponding to position 1,471 according to SEQ ID NO:54; comprises a guanine at a position corresponding to position 830 according to SEQ ID NO:104; comprises a guanine at a position corresponding to position 731 according to SEQ ID NO:105; comprises a guanine at a position corresponding to position 652 according to SEQ ID NO:106; or comprises a guanine at a position corresponding to position 891 according to SEQ ID NO:107, then the GPR75 nucleic acid molecule in the biological sample is a GPR75 missense variant nucleic acid molecule.

In some embodiments, the determining step, detecting step, or sequence analysis comprises: a) contacting the biological sample with a primer hybridizing to a portion of the nucleotide sequence of the GPR75: i) genomic nucleic acid molecule that is proximate to a position corresponding to positions 5,540-5,546 according to SEQ ID NO:2; ii) mRNA molecule that is proximate to a position corresponding to: positions 539-545 according to SEQ ID NO:11, positions 440-446 according to SEQ ID NO:16, positions 361-367 according to SEQ ID NO:21, or positions 600-606 according to SEQ ID NO:26; and/or iii) cDNA molecule that is proximate to a position corresponding to: positions 539-545 according to SEQ ID NO:35, positions 440-446 according to SEQ ID NO:40, positions 361-367 according to SEQ ID NO:45, or positions 600-606 according to SEQ ID NO:50; b) extending the primer at least through the position of the nucleotide sequence of the GPR75: i) genomic nucleic acid molecule corresponding to positions 5,540-5,546 according to SEQ ID NO:2; ii) mRNA molecule corresponding to: positions 539-545 according to SEQ ID NO:11, positions 440-446 according to SEQ ID NO:16, positions 361-367 according to SEQ ID NO:21, or positions 600-606 according to SEQ ID NO:26; and/or iii) cDNA molecule corresponding to: positions 539-545 according to SEQ ID NO:35, positions 440-446 according to SEQ ID NO:40, positions 361-367 according to SEQ ID NO:45, or positions 600-606 according to SEQ ID NO:50; and c) determining whether the extension product of the primer comprises: i) a deletion of a CCAGTAG heptanucleotide at positions corresponding to positions 5,540-5,546 according to SEQ ID NO:1; ii) a deletion of a CCAGUAG heptanucleotide at positions corresponding to positions 539-545 according to SEQ ID NO:7, a deletion of a CCAGUAG heptanucleotide at positions corresponding to positions 440-446 according to SEQ ID NO:8, a deletion of a CCAGUAG heptanucleotide at positions corresponding to positions 361-367 according to SEQ ID NO:9, or a deletion of a CCAGUAG heptanucleotide at positions corresponding to positions 600-606 according to SEQ ID NO:10; or iii) a deletion of a CCAGTAG heptanucleotide at positions corresponding to positions 539-545 according to SEQ ID NO:31, a deletion of a CCAGTAG heptanucleotide at positions corresponding to positions 440-446 according to SEQ ID NO:32, a deletion of a CCAGTAG heptanucleotide at positions corresponding to positions 361-367 according to SEQ ID NO:33, or a deletion of a CCAGTAG heptanucleotide at positions corresponding to positions 600-606 according to SEQ ID NO:34.

In some embodiments, the determining step, detecting step, or sequence analysis comprises: a) contacting the biological sample with a primer hybridizing to a portion of the nucleotide sequence of the GPR75: i) genomic nucleic acid molecule that is proximate to a position corresponding to position 5,557 according to SEQ ID NO:3; ii) mRNA molecule that is proximate to a position corresponding to: position 556 according to SEQ ID NO:12, position 457 according to SEQ ID NO:17, position 378 according to SEQ ID NO:22, position 617 according to SEQ ID NO:27 and/or iii) cDNA molecule that is proximate to a position corresponding to: position 556 according to SEQ ID NO:36, position 457 according to SEQ ID NO:41, position 378 according to SEQ ID NO:46, or position 617 according to SEQ ID NO:51; b) extending the primer at least through the position of the nucleotide sequence of the GPR75: i) genomic nucleic acid molecule corresponding to position 5,557 according to SEQ ID NO:3; ii) mRNA molecule corresponding to: position 556 according to SEQ ID NO:12, position 457 according to SEQ ID NO:17, position 378 according to SEQ ID NO:22, or position 617 according to SEQ ID NO:27; and/or iii) cDNA molecule corresponding to: position 556 according to SEQ ID NO:36, position 457 according to SEQ ID NO:41, position 378 according to SEQ ID NO:46, or position 617 according to SEQ ID NO:51; and c) determining whether the extension product of the primer comprises: i) an adenine at a position corresponding to position 5,557 according to SEQ ID NO:3; ii) an adenine at a position corresponding to position 556 according to SEQ ID NO:12, an adenine at a position corresponding to position 457 according to SEQ ID NO:17, an adenine at a position corresponding to position 378 according to SEQ ID NO:22, or an adenine at a position corresponding to position 617 according to SEQ ID NO:27; or iii) an adenine at a position corresponding to position 556 according to SEQ ID NO:36, an adenine at a position corresponding to position 457 according to SEQ ID NO:41, an adenine at a position corresponding to position 378 according to SEQ ID NO:46, or an adenine at a position corresponding to position 617 according to SEQ ID NO:51.

In some embodiments, the determining step, detecting step, or sequence analysis comprises: a) contacting the biological sample with a primer hybridizing to a portion of the nucleotide sequence of the GPR75: i) genomic nucleic acid molecule that is proximate to a position corresponding to position 5,911 according to SEQ ID NO:4; ii) mRNA molecule that is proximate to a position corresponding to: position 910 according to SEQ ID NO:13, position 811 according to SEQ ID NO:18, position 732 according to SEQ ID NO:23, or position 971 according to SEQ ID NO:28; and/or iii) cDNA molecule that is proximate to a position corresponding to: position 910 according to SEQ ID NO:37, position 811 according to SEQ ID NO:42, position 732 according to SEQ ID NO:47, or position 971 according to SEQ ID NO:52; b) extending the primer at least through the position of the nucleotide sequence of the GPR75: i) genomic nucleic acid molecule corresponding to position 5,911 according to SEQ ID NO:4; ii) mRNA molecule corresponding to: position 910 according to SEQ ID NO:13, position 811 according to SEQ ID NO:18, position 732 according to SEQ ID NO:23, or position 971 according to SEQ ID NO:28; and/or iii) cDNA molecule corresponding to: position 910 according to SEQ ID NO:37, position 811 according to SEQ ID NO:42, position 732 according to SEQ ID NO:47, or position 971 according to SEQ ID NO:52; and c) determining whether the extension product of the primer comprises: i) a thymine at a position corresponding to position 5,911 according to SEQ ID NO:4; ii) a uracil at a position corresponding to position 910 according to SEQ ID NO:13, a uracil at a position corresponding to position 811 according to SEQ ID NO:18, a uracil at a position corresponding to position 732 according to SEQ ID NO:23, or a uracil at a position corresponding to position 971 according to SEQ ID NO:28; or iii) a thymine at a position corresponding to position 910 according to SEQ ID NO:37, a thymine at a position corresponding to position 811 according to SEQ ID NO:42, a thymine at a position corresponding to position 732 according to SEQ ID NO:47, or a thymine at a position corresponding to position 971 according to SEQ ID NO:52.

In some embodiments, the determining step, detecting step, or sequence analysis comprises: a) contacting the biological sample with a primer hybridizing to a portion of the nucleotide sequence of the GPR75: i) genomic nucleic acid molecule that is proximate to a position corresponding to positions 5,920-5,923 according to SEQ ID NO:5; ii) mRNA molecule that is proximate to a position corresponding to: positions 919-922 according to SEQ ID NO:14, positions 820-823 according to SEQ ID NO:19, positions 741-744 according to SEQ ID NO:24, or positions 980-983 according to SEQ ID NO:29; and/or iii) cDNA molecule that is proximate to a position corresponding to: positions 919-922 according to SEQ ID NO:38, positions 820-823 according to SEQ ID NO:43, positions 741-744 according to SEQ ID NO:48, or positions 980-983 according to SEQ ID NO:53; b) extending the primer at least through the position of the nucleotide sequence of the GPR75: i) genomic nucleic acid molecule corresponding to positions 5,920-5,923 according to SEQ ID NO:5; ii) mRNA molecule corresponding to: positions 919-922 according to SEQ ID NO:14, positions 820-823 according to SEQ ID NO:19, positions 741-744 according to SEQ ID NO:24, or positions 980-983 according to SEQ ID NO:29; and/or iii) cDNA molecule corresponding to: positions 919-922 according to SEQ ID NO:38, positions 820-823 according to SEQ ID NO:43, positions 741-744 according to SEQ ID NO:48, or positions 980-983 according to SEQ ID NO:53; and c) determining whether the extension product of the primer comprises: i) a deletion of an AAAG tetranucleotide at positions corresponding to positions 5,920-5,923 according to SEQ ID NO:1; ii) a deletion of an AAAG tetranucleotide at positions corresponding to positions 919-922 according to SEQ ID NO:7, a deletion of an AAAG tetranucleotide at positions corresponding to positions 820-823 according to SEQ ID NO:8, a deletion of an AAAG tetranucleotide at positions corresponding to positions 741-744 according to SEQ ID NO:9, or a deletion of an AAAG tetranucleotide at positions corresponding to positions 980-983 according to SEQ ID NO:10; or iii) a deletion of an AAAG tetranucleotide at positions corresponding to positions 919-922 according to SEQ ID NO:31, a deletion of an AAAG tetranucleotide at positions corresponding to positions 820-823 according to SEQ ID NO:32, a deletion of an AAAG tetranucleotide at positions corresponding to positions 741-744 according to SEQ ID NO:33, or a deletion of an AAAG tetranucleotide at positions corresponding to positions 980-983 according to SEQ ID NO:34.

In some embodiments, the determining step, detecting step, or sequence analysis comprises: a) contacting the biological sample with a primer hybridizing to a portion of the nucleotide sequence of the GPR75: i) genomic nucleic acid molecule that is proximate to a position corresponding to position 6,411 according to SEQ ID NO:6; ii) mRNA molecule that is proximate to a position corresponding to: position 1,410 according to SEQ ID NO:15, position 1,311 according to SEQ ID NO:20, position 1,232 according to SEQ ID NO:25, or position 1,471 according to SEQ ID NO:30; and/or iii) cDNA molecule that is proximate to a position corresponding to: position 1,410 according to SEQ ID NO:39, position 1,311 according to SEQ ID NO:44, position 1,232 according to SEQ ID NO:49, or position 1,471 according to SEQ ID NO:54; b) extending the primer at least through the position of the nucleotide sequence of the GPR75: i) genomic nucleic acid molecule corresponding to position 6,411 according to SEQ ID NO:6; ii) mRNA molecule corresponding to: position 1,410 according to SEQ ID NO:15, position 1,311 according to SEQ ID NO:20, position 1,232 according to SEQ ID NO:25, or position 1,471 according to SEQ ID NO:30; and/or iii) cDNA molecule corresponding to: position 1,410 according to SEQ ID NO:39, position 1,311 according to SEQ ID NO:44, position 1,232 according to SEQ ID NO:49, or position 1,471 according to SEQ ID NO:54; and c) determining whether the extension product of the primer comprises: i) an insertion of a thymine at a position corresponding to position 6,411 according to SEQ ID NO:6; ii) an insertion of a uracil at a position corresponding to position 1,410 according to SEQ ID NO:15, an insertion of a uracil at a position corresponding to position 1,311 according to SEQ ID NO:20, an insertion of a uracil at a position corresponding to position 1,232 according to SEQ ID NO:25, or an insertion of a uracil at a position corresponding to position 1,471 according to SEQ ID NO:30; or iii) an insertion of a thymine at a position corresponding to position 1,410 according to SEQ ID NO:39, an insertion of a thymine at a position corresponding to position 1,311 according to SEQ ID NO:44, an insertion of a thymine at a position corresponding to position 1,232 according to SEQ ID NO:49, or an insertion of a thymine at a position corresponding to position 1,471 according to SEQ ID NO:54.

In some embodiments, the determining step, detecting step, or sequence analysis comprises: a) contacting the biological sample with a primer hybridizing to a portion of the nucleotide sequence of the GPR75: i) genomic nucleic acid molecule that is proximate to a position corresponding to position 5,831 according to SEQ ID NO:99; ii) mRNA molecule that is proximate to a position corresponding to: position 830 according to SEQ ID NO:100; position 731 according to SEQ ID NO:101; position 652 according to SEQ ID NO:102; or position 891 according to SEQ ID NO:103; and/or iii) cDNA molecule that is proximate to a position corresponding to: position 830 according to SEQ ID NO:104; position 731 according to SEQ ID NO:105; position 652 according to SEQ ID NO:106; or position 891 according to SEQ ID NO:107; b) extending the primer at least through the position of the nucleotide sequence of the GPR75: i) genomic nucleic acid molecule that is proximate to a position corresponding to position 5,831 according to SEQ ID NO:99; ii) mRNA molecule that is proximate to a position corresponding to: position 830 according to SEQ ID NO:100; position 731 according to SEQ ID NO:101; position 652 according to SEQ ID NO:102; or position 891 according to SEQ ID NO:103; and/or iii) cDNA molecule that is proximate to a position corresponding to: position 830 according to SEQ ID NO:104; position 731 according to SEQ ID NO:105; position 652 according to SEQ ID NO:106; or position 891 according to SEQ ID NO:107; and c) determining whether the extension product of the primer comprises: i) a guanine at a position corresponding to position 5,831 according to SEQ ID NO:99, or the complement thereof; ii) a guanine at a position corresponding to position 830 according to SEQ ID NO:100, or the complement thereof; a guanine at a position corresponding to position 731 according to SEQ ID NO:101, or the complement thereof; a guanine at a position corresponding to position 652 according to SEQ ID NO:102, or the complement thereof; or a guanine at a position corresponding to position 891 according to SEQ ID NO:103, or the complement thereof; or iii) a guanine at a position corresponding to position 830 according to SEQ ID NO:104, or the complement thereof; a guanine at a position corresponding to position 731 according to SEQ ID NO:105, or the complement thereof; a guanine at a position corresponding to position 652 according to SEQ ID NO:106; or the complement thereof; or a guanine at a position corresponding to position 891 according to SEQ ID NO:107, or the complement thereof.

In some embodiments, the determining step, detecting step, or sequence analysis comprises: a) contacting the biological sample with a primer hybridizing to a portion of the nucleotide sequence of the GPR75 genomic nucleic acid molecule that is proximate to a position corresponding to: positions 5,540-5,546 according to SEQ ID NO:2, position 5,557 according to SEQ ID NO:3, position 5,911 according to SEQ ID NO:4, positions 5,920-5,923 according to SEQ ID NO:5, position 6,411 according to SEQ ID NO:6, or position 5,831 according to SEQ ID NO:99; b) extending the primer at least through the position of the nucleotide sequence of the GPR75 genomic nucleic acid molecule corresponding to: positions 5,540-5,546 according to SEQ ID NO:2, position 5,557 according to SEQ ID NO:3, position 5,911 according to SEQ ID NO:4, positions 5,920-5,923 according to SEQ ID NO:5, position 6,411 according to SEQ ID NO:6, or position 5,831 according to SEQ ID NO:99; and c) determining whether the extension product of the primer: lacks a CCAGTAG heptanucleotide at positions corresponding to positions 5,540-5,546 according to SEQ ID NO:1, comprises an adenine at a position corresponding to position 5,557 according to SEQ ID NO:3, comprises a thymine at a position corresponding to position 5,911 according to SEQ ID NO:4, lacks an AAAG tetranucleotide at positions corresponding to positions 5,920-5,923 according to SEQ ID NO:1, comprises an insertion of a thymine at a position corresponding to position 6,411 according to SEQ ID NO:6, or comprises a guanine at a position corresponding to position 5,831 according to SEQ ID NO:99, or the complement thereof.

In some embodiments, the determining step, detecting step, or sequence analysis comprises: a) contacting the biological sample with a primer hybridizing to a portion of the nucleotide sequence of the GPR75 mRNA molecule that is proximate to a position corresponding to: positions 539-545 according to SEQ ID NO:11, positions 440-446 according to SEQ ID NO:16, positions 361-367 according to SEQ ID NO:21, positions 600-606 according to SEQ ID NO:26, position 556 according to SEQ ID NO:12, position 457 according to SEQ ID NO:17, position 378 according to SEQ ID NO:22, position 617 according to SEQ ID NO:27, position 910 according to SEQ ID NO:13, position 811 according to SEQ ID NO:18, position 732 according to SEQ ID NO:23, position 971 according to SEQ ID NO:28, positions 919-922 according to SEQ ID NO:14, positions 820-823 according to SEQ ID NO:19, positions 741-744 according to SEQ ID NO:24, positions 980-983 according to SEQ ID NO:29, position 1,410 according to SEQ ID NO:15, position 1,311 according to SEQ ID NO:20, position 1,232 according to SEQ ID NO:25, position 1,471 according to SEQ ID NO:30; position 830 according to SEQ ID NO:100; position 731 according to SEQ ID NO:101; position 652 according to SEQ ID NO:102; or position 891 according to SEQ ID NO:103; b) extending the primer at least through the position of the nucleotide sequence of the GPR75 mRNA molecule corresponding to: positions 539-545 according to SEQ ID NO:11, positions 440-446 according to SEQ ID NO:16, positions 361-367 according to SEQ ID NO:21, positions 600-606 according to SEQ ID NO:26, position 556 according to SEQ ID NO:12, position 457 according to SEQ ID NO:17, position 378 according to SEQ ID NO:22, position 617 according to SEQ ID NO:27, position 910 according to SEQ ID NO:13, position 811 according to SEQ ID NO:18, position 732 according to SEQ ID NO:23, position 971 according to SEQ ID NO:28, positions 919-922 according to SEQ ID NO:14, positions 820-823 according to SEQ ID NO:19, positions 741-744 according to SEQ ID NO:24, positions 980-983 according to SEQ ID NO:29, position 1,410 according to SEQ ID NO:15, position 1,311 according to SEQ ID NO:20, position 1,232 according to SEQ ID NO:25, position 1,471 according to SEQ ID NO:30, position 830 according to SEQ ID NO:100, position 731 according to SEQ ID NO:101, position 652 according to SEQ ID NO:102, or position 891 according to SEQ ID NO:103; and c) determining whether the extension product of the primer: lacks a CCAGUAG heptanucleotide at positions corresponding to positions 539-545 according to SEQ ID NO:7, lacks a CCAGUAG heptanucleotide at positions corresponding to positions 440-446 according to SEQ ID NO:8, lacks a CCAGUAG heptanucleotide at positions corresponding to positions 361-367 according to SEQ ID NO:9, lacks a CCAGUAG heptanucleotide at positions corresponding to positions 600-606 according to SEQ ID NO:10, comprises an adenine at a position corresponding to position 556 according to SEQ ID NO:12, comprises an adenine at a position corresponding to position 457 according to SEQ ID NO:17, comprises an adenine at a position corresponding to position 378 according to SEQ ID NO:22, comprises an adenine at a position corresponding to position 617 according to SEQ ID NO:27, comprises a uracil at a position corresponding to position 910 according to SEQ ID NO:13, comprises a uracil at a position corresponding to position 811 according to SEQ ID NO:18, comprises a uracil at a position corresponding to position 732 according to SEQ ID NO:23, comprises a uracil at a position corresponding to position 971 according to SEQ ID NO:28, lacks an AAAG tetranucleotide at positions corresponding to positions 919-922 according to SEQ ID NO:7, lacks an AAAG tetranucleotide at positions corresponding to positions 820-823 according to SEQ ID NO:8, lacks an AAAG tetranucleotide at positions corresponding to positions 741-744 according to SEQ ID NO:9, lacks an AAAG tetranucleotide at positions corresponding to positions 980-983 according to SEQ ID NO:10, comprises an insertion of a uracil at a position corresponding to position 1,410 according to SEQ ID NO:15, comprises an insertion of a uracil at a position corresponding to position 1,311 according to SEQ ID NO:20, comprises an insertion of a uracil at a position corresponding to position 1,232 according to SEQ ID NO:25, comprises an insertion of a uracil at a position corresponding to position 1,471 according to SEQ ID NO:30, comprises a guanine at a position corresponding to position 830 according to SEQ ID NO:100, comprises a guanine at a position corresponding to position 731 according to SEQ ID NO:101, comprises a guanine at a position corresponding to position 652 according to SEQ ID NO:102, or comprises a guanine at a position corresponding to position 891 according to SEQ ID NO:103.

In some embodiments, the determining step, detecting step, or sequence analysis comprises: a) contacting the biological sample with a primer hybridizing to a portion of the nucleotide sequence of the GPR75 cDNA molecule that is proximate to a position corresponding to: positions 539-545 according to SEQ ID NO:35, positions 440-446 according to SEQ ID NO:40, positions 361-367 according to SEQ ID NO:45, positions 600-606 according to SEQ ID NO:50, position 556 according to SEQ ID NO:36, position 457 according to SEQ ID NO:41, position 378 according to SEQ ID NO:46, position 617 according to SEQ ID NO:51, position 910 according to SEQ ID NO:37, position 811 according to SEQ ID NO:42, position 732 according to SEQ ID NO:47, position 971 according to SEQ ID NO:52, positions 919-922 according to SEQ ID NO:38, positions 820-823 according to SEQ ID NO:43, positions 741-744 according to SEQ ID NO:48, positions 980-983 according to SEQ ID NO:53, position 1,410 according to SEQ ID NO:39, position 1,311 according to SEQ ID NO:44, position 1,232 according to SEQ ID NO:49, position 1,471 according to SEQ ID NO:54, position 830 according to SEQ ID NO:104, position 731 according to SEQ ID NO:105, position 652 according to SEQ ID NO:106, or position 891 according to SEQ ID NO:107; b) extending the primer at least through the position of the nucleotide sequence of the GPR75 cDNA molecule corresponding to: positions 539-545 according to SEQ ID NO:35, positions 440-446 according to SEQ ID NO:40, positions 361-367 according to SEQ ID NO:45, positions 600-606 according to SEQ ID NO:50, position 556 according to SEQ ID NO:36, position 457 according to SEQ ID NO:41, position 378 according to SEQ ID NO:46, position 617 according to SEQ ID NO:51, position 910 according to SEQ ID NO:37, position 811 according to SEQ ID NO:42, position 732 according to SEQ ID NO:47, position 971 according to SEQ ID NO:52, positions 919-922 according to SEQ ID NO:38, positions 820-823 according to SEQ ID NO:43, positions 741-744 according to SEQ ID NO:48, positions 980-983 according to SEQ ID NO:53, position 1,410 according to SEQ ID NO:39, position 1,311 according to SEQ ID NO:44, position 1,232 according to SEQ ID NO:49, position 1,471 according to SEQ ID NO:54, position 830 according to SEQ ID NO:104, position 731 according to SEQ ID NO:105, position 652 according to SEQ ID NO:106, or position 891 according to SEQ ID NO:107; and c) determining whether the extension product of the primer: lacks a CCAGTAG heptanucleotide at positions corresponding to positions 539-545 according to SEQ ID NO:31, lacks a CCAGTAG heptanucleotide at positions corresponding to positions 440-446 according to SEQ ID NO:32, lacks a CCAGTAG heptanucleotide at positions corresponding to positions 361-367 according to SEQ ID NO:33, lacks a CCAGTAG heptanucleotide at positions corresponding to positions 600-606 according to SEQ ID NO:34, comprises an adenine at a position corresponding to position 556 according to SEQ ID NO:36, comprises an adenine at a position corresponding to position 457 according to SEQ ID NO:41, comprises an adenine at a position corresponding to position 378 according to SEQ ID NO:46, comprises an adenine at a position corresponding to position 617 according to SEQ ID NO:51, comprises a thymine at a position corresponding to position 910 according to SEQ ID NO:37, comprises a thymine at a position corresponding to position 811 according to SEQ ID NO:42, comprises a thymine at a position corresponding to position 732 according to SEQ ID NO:47, comprises a thymine at a position corresponding to position 971 according to SEQ ID NO:52, lacks an AAAG tetranucleotide at positions corresponding to positions 919-922 according to SEQ ID NO:31, lacks an AAAG tetranucleotide at positions corresponding to positions 820-823 according to SEQ ID NO:32, lacks an AAAG tetranucleotide at positions corresponding to positions 741-744 according to SEQ ID NO:33, lacks an AAAG tetranucleotide at positions corresponding to positions 980-983 according to SEQ ID NO:34, comprises an insertion of a thymine at a position corresponding to position 1,410 according to SEQ ID NO:39, comprises an insertion of a thymine at a position corresponding to position 1,311 according to SEQ ID NO:44, comprises an insertion of a thymine at a position corresponding to position 1,232 according to SEQ ID NO:49, or comprises an insertion of a thymine at a position corresponding to position 1,471 according to SEQ ID NO:54, comprises a guanine at a position corresponding to position 830 according to SEQ ID NO:104, comprises a guanine at a position corresponding to position 731 according to SEQ ID NO:105, comprises a guanine at a position corresponding to position 652 according to SEQ ID NO:106, or comprises a guanine at a position corresponding to position 891 according to SEQ ID NO:107.

In some embodiments, the assay comprises sequencing the entire nucleic acid molecule. In some embodiments, only a GPR75 genomic nucleic acid molecule is analyzed. In some embodiments, only a GPR75 mRNA is analyzed. In some embodiments, only a GPR75 cDNA obtained from GPR75 mRNA is analyzed.

In some embodiments, the determining step, detecting step, or sequence analysis comprises: a) amplifying at least a portion of the nucleic acid molecule that encodes the human GPR75 polypeptide, wherein the amplified portion comprises: i) a deletion of a CCAGTAG heptanucleotide at positions corresponding to positions 5,540-5,546 according to SEQ ID NO:1, or the complement thereof; ii) a deletion of a CCAGUAG heptanucleotide at positions corresponding to positions 539-545 according to SEQ ID NO:7, or the complement thereof; a deletion of a CCAGUAG heptanucleotide at positions corresponding to positions 440-446 according to SEQ ID NO:8, or the complement thereof; a deletion of a CCAGUAG heptanucleotide at positions corresponding to positions 361-367 according to SEQ ID NO:9, or the complement thereof; or a deletion of a CCAGUAG heptanucleotide at positions corresponding to positions 600-606 according to SEQ ID NO:10, or the complement thereof; and/or iii) a deletion of a CCAGTAG heptanucleotide at positions corresponding to positions 539-545 according to SEQ ID NO:31, or the complement thereof; a deletion of a CCAGTAG heptanucleotide at positions corresponding to positions 440-446 according to SEQ ID NO:32, or the complement thereof; a deletion of a CCAGTAG heptanucleotide at positions corresponding to positions 361-367 according to SEQ ID NO:33, or the complement thereof; or a deletion of a CCAGTAG heptanucleotide at positions corresponding to positions 600-606 according to SEQ ID NO:34, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: i) lacking a CCAGTAG heptanucleotide at positions corresponding to positions 5,540-5,546 according to SEQ ID NO:1, or the complement thereof; ii) lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; or lacking a CCAGUAG heptanucleotide at positions corresponding to positions 600-606 according to SEQ ID NO:10, or the complement thereof; and/or iii) lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; or lacking a CCAGTAG heptanucleotide at positions corresponding to positions 600-606 according to SEQ ID NO:34, or the complement thereof; and d) detecting the detectable label.

In some embodiments, the determining step, detecting step, or sequence analysis comprises: a) amplifying at least a portion of the nucleic acid molecule that encodes the human GPR75 polypeptide, wherein the amplified portion comprises: i) an adenine at a position corresponding to position 5,557 according to SEQ ID NO:3, or the complement thereof; ii) an adenine at a position corresponding to position 556 according to SEQ ID NO:12, or the complement thereof; an adenine at a position corresponding to position 457 according to SEQ ID NO:17, or the complement thereof; an adenine at a position corresponding to position 378 according to SEQ ID NO:22, or the complement thereof; or an adenine at a position corresponding to position 617 according to SEQ ID NO:27, or the complement thereof; and/or iii) an adenine at a position corresponding to position 556 according to SEQ ID NO:36, or the complement thereof; an adenine at a position corresponding to position 457 according to SEQ ID NO:41, or the complement thereof; an adenine at a position corresponding to position 378 according to SEQ ID NO:46, or the complement thereof; or an adenine at a position corresponding to position 617 according to SEQ ID NO:51, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: i) an adenine at a position corresponding to position 5,557 according to SEQ ID NO:3, or the complement thereof; ii) an adenine at a position corresponding to position 556 according to SEQ ID NO:12, or the complement thereof; an adenine at a position corresponding to position 457 according to SEQ ID NO:17, or the complement thereof; an adenine at a position corresponding to position 378 according to SEQ ID NO:22, or the complement thereof; or an adenine at a position corresponding to position 617 according to SEQ ID NO:27, or the complement thereof; and/or iii) an adenine at a position corresponding to position 556 according to SEQ ID NO:36, or the complement thereof; an adenine at a position corresponding to position 457 according to SEQ ID NO:41, or the complement thereof; an adenine at a position corresponding to position 378 according to SEQ ID NO:46, or the complement thereof; or an adenine at a position corresponding to position 617 according to SEQ ID NO:51, or the complement thereof; and d) detecting the detectable label.

In some embodiments, the determining step, detecting step, or sequence analysis comprises: a) amplifying at least a portion of the nucleic acid molecule that encodes the human GPR75 polypeptide, wherein the amplified portion comprises: i) a thymine at a position corresponding to position 5,911 according to SEQ ID NO:4, or the complement thereof; ii) a uracil at a position corresponding to position 910 according to SEQ ID NO:13, or the complement thereof; a uracil at a position corresponding to position 811 according to SEQ ID NO:18, or the complement thereof; a uracil at a position corresponding to position 732 according to SEQ ID NO:23, or the complement thereof; or a uracil at a position corresponding to position 971 according to SEQ ID NO:28, or the complement thereof; and/or iii) a thymine at a position corresponding to position 910 according to SEQ ID NO:37, or the complement thereof; a thymine at a position corresponding to position 811 according to SEQ ID NO:42, or the complement thereof; a thymine at a position corresponding to position 732 according to SEQ ID NO:47, or the complement thereof; or a thymine at a position corresponding to position 971 according to SEQ ID NO:52, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: i) a thymine at a position corresponding to position 5,911 according to SEQ ID NO:4, or the complement thereof; ii) a uracil at a position corresponding to position 910 according to SEQ ID NO:13, or the complement thereof; a uracil at a position corresponding to position 811 according to SEQ ID NO:18, or the complement thereof; a uracil at a position corresponding to position 732 according to SEQ ID NO:23, or the complement thereof; or a uracil at a position corresponding to position 971 according to SEQ ID NO:28, or the complement thereof; and/or iii) a thymine at a position corresponding to position 910 according to SEQ ID NO:37, or the complement thereof; a thymine at a position corresponding to position 811 according to SEQ ID NO:42, or the complement thereof; a thymine at a position corresponding to position 732 according to SEQ ID NO:47, or the complement thereof; or a thymine at a position corresponding to position 971 according to SEQ ID NO:52, or the complement thereof; and d) detecting the detectable label.

In some embodiments, the determining step, detecting step, or sequence analysis comprises: a) amplifying at least a portion of the nucleic acid molecule that encodes the human GPR75 polypeptide, wherein the amplified portion comprises: i) a deletion of an AAAG tetranucleotide at positions corresponding to positions 5,920-5,923 according to SEQ ID NO:1, or the complement thereof; ii) a deletion of an AAAG tetranucleotide at positions corresponding to positions 919-922 according to SEQ ID NO:7, or the complement thereof; a deletion of an AAAG tetranucleotide at positions corresponding to positions 820-823 according to SEQ ID NO:8, or the complement thereof; a deletion of an AAAG tetranucleotide at positions corresponding to positions 741-744 according to SEQ ID NO:9, or the complement thereof; or a deletion of an AAAG tetranucleotide at positions corresponding to positions 980-983 according to SEQ ID NO:10, or the complement thereof; and/or iii) a deletion of an AAAG tetranucleotide at positions corresponding to positions 919-922 according to SEQ ID NO:31, or the complement thereof; a deletion of an AAAG tetranucleotide at positions corresponding to positions 820-823 according to SEQ ID NO:32, or the complement thereof; a deletion of an AAAG tetranucleotide at positions corresponding to positions 741-744 according to SEQ ID NO:33, or the complement thereof; or a deletion of an AAAG tetranucleotide at positions corresponding to positions 980-983 according to SEQ ID NO:34, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: i) lacking an AAAG tetranucleotide at positions corresponding to positions 5,920-5,923 according to SEQ ID NO:1, or the complement thereof; ii) lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; or lacking an AAAG tetranucleotide at positions corresponding to positions 980-983 according to SEQ ID NO:10, or the complement thereof; and/or iii) lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; or lacking an AAAG tetranucleotide at positions corresponding to positions 980-983 according to SEQ ID NO:34, or the complement thereof; and d) detecting the detectable label.

In some embodiments, the determining step, detecting step, or sequence analysis comprises: a) amplifying at least a portion of the nucleic acid molecule that encodes the human GPR75 polypeptide, wherein the amplified portion comprises: i) an insertion of a thymine at a position corresponding to position 6,411 according to SEQ ID NO:6, or the complement thereof; ii) an insertion of a uracil at a position corresponding to position 1,410 according to SEQ ID NO:15, or the complement thereof; an insertion of a uracil at a position corresponding to position 1,311 according to SEQ ID NO:20, or the complement thereof; an insertion of a uracil at a position corresponding to position 1,232 according to SEQ ID NO:25, or the complement thereof; or an insertion of a uracil at a position corresponding to position 1,471 according to SEQ ID NO:30, or the complement thereof; and/or iii) an insertion of a thymine at a position corresponding to position 1,410 according to SEQ ID NO:39, or the complement thereof; an insertion of a thymine at a position corresponding to position 1,311 according to SEQ ID NO:44, or the complement thereof; an insertion of a thymine at a position corresponding to position 1,232 according to SEQ ID NO:49, or the complement thereof; or an insertion of a thymine at a position corresponding to position 1,471 according to SEQ ID NO:54, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: i) an insertion of a thymine at a position corresponding to position 6,411 according to SEQ ID NO:6, or the complement thereof; ii) an insertion of a uracil at a position corresponding to position 1,410 according to SEQ ID NO:15, or the complement thereof; an insertion of a uracil at a position corresponding to position 1,311 according to SEQ ID NO:20, or the complement thereof; an insertion of a uracil at a position corresponding to position 1,232 according to SEQ ID NO:25, or the complement thereof; or an insertion of a uracil at a position corresponding to position 1,471 according to SEQ ID NO:30, or the complement thereof; and/or iii) an insertion of a thymine at a position corresponding to position 1,410 according to SEQ ID NO:39, or the complement thereof; an insertion of a thymine at a position corresponding to position 1,311 according to SEQ ID NO:44, or the complement thereof; an insertion of a thymine at a position corresponding to position 1,232 according to SEQ ID NO:49, or the complement thereof; or an insertion of a thymine at a position corresponding to position 1,471 according to SEQ ID NO:54, or the complement thereof; and d) detecting the detectable label.

In some embodiments, the determining step, detecting step, or sequence analysis comprises: a) amplifying at least a portion of the nucleic acid molecule that encodes the human GPR75 polypeptide, wherein the amplified portion comprises: i) a guanine at a position corresponding to position 5,831 according to SEQ ID NO:99, or the complement thereof; ii) a guanine at a position corresponding to position 830 according to SEQ ID NO:100, or the complement thereof; a guanine at a position corresponding to position 731 according to SEQ ID NO:101, or the complement thereof; a guanine at a position corresponding to position 652 according to SEQ ID NO:102, or the complement thereof; or a guanine at a position corresponding to position 891 according to SEQ ID NO:103, or the complement thereof; and/or iii) a guanine at a position corresponding to position 830 according to SEQ ID NO:104, or the complement thereof; a guanine at a position corresponding to position 731 according to SEQ ID NO:105, or the complement thereof; a guanine at a position corresponding to position 652 according to SEQ ID NO:106, or the complement thereof; or a guanine at a position corresponding to position 891 according to SEQ ID NO:107, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising: i) a guanine at a position corresponding to position 5,831 according to SEQ ID NO:99, or the complement thereof; ii) a guanine at a position corresponding to position 830 according to SEQ ID NO:100, or the complement thereof; a guanine at a position corresponding to position 731 according to SEQ ID NO:101, or the complement thereof; a guanine at a position corresponding to position 652 according to SEQ ID NO:102, or the complement thereof; or a guanine at a position corresponding to position 891 according to SEQ ID NO:103, or the complement thereof; and/or iii) a guanine at a position corresponding to position 830 according to SEQ ID NO:104, or the complement thereof; a guanine at a position corresponding to position 731 according to SEQ ID NO:105, or the complement thereof; a guanine at a position corresponding to position 652 according to SEQ ID NO:106, or the complement thereof; or a guanine at a position corresponding to position 891 according to SEQ ID NO:107, or the complement thereof; and d) detecting the detectable label.

In some embodiments, the determining step, detecting step, or sequence analysis comprises: a) amplifying at least a portion of the nucleic acid molecule that encodes the human GPR75 polypeptide, wherein the amplified portion: lacks a CCAGTAG heptanucleotide at positions corresponding to positions 5,540-5,546 according to SEQ ID NO:1, or the complement thereof; comprises an adenine at a position corresponding to position 5,557 according to SEQ ID NO:3, or the complement thereof; comprises a thymine at a position corresponding to position 5,911 according to SEQ ID NO:4, or the complement thereof; lacks an AAAG tetranucleotide at positions corresponding to positions 5,920-5, 923 according to SEQ ID NO:1, the complement thereof; comprises an insertion of a thymine at a position corresponding to position 6,411 according to SEQ ID NO:6, or the complement thereof; or comprises a guanine at a position corresponding to position 5,831 according to SEQ ID NO:99, or the complement thereof or; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGTAG heptanucleotide at positions corresponding to positions 5,540-5,546 according to SEQ ID NO:1, or the complement thereof; comprising an adenine at a position corresponding to position 5,557 according to SEQ ID NO:3, or the complement thereof; comprising a thymine at a position corresponding to position 5,911 according to SEQ ID NO:4, or the complement thereof; lacking an AAAG tetranucleotide at positions corresponding to positions 5,920-5,923 according to SEQ ID NO:1, or the complement thereof; comprising an insertion of a thymine at a position corresponding to position 6,411 according to SEQ ID NO:6, or the complement thereof; or comprising a guanine at a position corresponding to position 5,831 according to SEQ ID NO:99, or the complement thereof; and d) detecting the detectable label.

In some embodiments, the determining step, detecting step, or sequence analysis comprises: a) amplifying at least a portion of the nucleic acid molecule that encodes the human GPR75 polypeptide, wherein the amplified portion: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; comprises an adenine at a position corresponding to position 556 according to SEQ ID NO:12, or the complement thereof; comprises an adenine at a position corresponding to position 457 according to SEQ ID NO:17, or the complement thereof; comprises an adenine at a position corresponding to position 378 according to SEQ ID NO:22, or the complement thereof; comprises an adenine at a position corresponding to position 617 according to SEQ ID NO:27, or the complement thereof; comprises a uracil at a position corresponding to position 910 according to SEQ ID NO:13, or the complement thereof; comprises a uracil at a position corresponding to position 811 according to SEQ ID NO:18, or the complement thereof; comprises a uracil at a position corresponding to position 732 according to SEQ ID NO:23, or the complement thereof; comprises a uracil at a position corresponding to position 971 according to SEQ ID NO:28, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; comprises an insertion of a uracil at a position corresponding to position 1,471 according to SEQ ID NO:30, or the complement thereof; comprises a guanine at a position corresponding to position 830 according to SEQ ID NO:100, or the complement thereof; comprises a guanine at a position corresponding to position 731 according to SEQ ID NO:101, or the complement thereof; comprises a guanine at a position corresponding to position 652 according to SEQ ID NO:102, or the complement thereof; or comprises a guanine at a position corresponding to position 891 according to SEQ ID NO:103, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; lacking a CCAGUAG heptanucleotide at positions corresponding to positions 600-606 according to SEQ ID NO:10, or the complement thereof; comprising an adenine at a position corresponding to position 556 according to SEQ ID NO:12, or the complement thereof; comprising an adenine at a position corresponding to position 457 according to SEQ ID NO:17, or the complement thereof; comprising an adenine at a position corresponding to position 378 according to SEQ ID NO:22, or the complement thereof; comprising an adenine at a position corresponding to position 617 according to SEQ ID NO:27, or the complement thereof; comprising a uracil at a position corresponding to position 910 according to SEQ ID NO:13, or the complement thereof; comprising a uracil at a position corresponding to position 811 according to SEQ ID NO:18, or the complement thereof; comprising a uracil at a position corresponding to position 732 according to SEQ ID NO:23, or the complement thereof; comprising a uracil at a position corresponding to position 971 according to SEQ ID NO:28, or the complement thereof; lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; lacking an AAAG tetranucleotide at positions corresponding to positions 980-983 according to SEQ ID NO:10, or the complement thereof; comprising an insertion of a uracil at a position corresponding to position 1,410 according to SEQ ID NO:15, or the complement thereof; comprising an insertion of a uracil at a position corresponding to position 1,311 according to SEQ ID NO:20, or the complement thereof; comprising an insertion of a uracil at a position corresponding to position 1,232 according to SEQ ID NO:25, or the complement thereof; comprising an insertion of a uracil at a position corresponding to position 1,471 according to SEQ ID NO:30, or the complement thereof; comprising a guanine at a position corresponding to position 830 according to SEQ ID NO:100, or the complement thereof; comprising a guanine at a position corresponding to position 731 according to SEQ ID NO:101, or the complement thereof; comprising a guanine at a position corresponding to position 652 according to SEQ ID NO:102, or the complement thereof; or comprising a guanine at a position corresponding to position 891 according to SEQ ID NO:103, or the complement thereof.

In some embodiments, the determining step, detecting step, or sequence analysis comprises: a) amplifying at least a portion of the nucleic acid molecule that encodes the human GPR75 polypeptide, wherein the amplified portion: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; comprises an adenine at a position corresponding to position 556 according to SEQ ID NO:36, or the complement thereof; comprises an adenine at a position corresponding to position 457 according to SEQ ID NO:41, or the complement thereof; comprises an adenine at a position corresponding to position 378 according to SEQ ID NO:46, or the complement thereof; comprises an adenine at a position corresponding to position 617 according to SEQ ID NO:51, or the complement thereof; comprises a thymine at a position corresponding to position 910 according to SEQ ID NO:37, or the complement thereof; comprises a thymine at a position corresponding to position 811 according to SEQ ID NO:42, or the complement thereof; comprises a thymine at a position corresponding to position 732 according to SEQ ID NO:47, or the complement thereof; comprises a thymine at a position corresponding to position 971 according to SEQ ID NO:52, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, or the complement thereof; comprises an insertion of a thymine at a position corresponding to position 1,471 according to SEQ ID NO:54, or the complement thereof; comprises a guanine at a position corresponding to position 830 according to SEQ ID NO:104, or the complement thereof; comprises a guanine at a position corresponding to position 731 according to SEQ ID NO:105, or the complement thereof; comprises a guanine at a position corresponding to position 652 according to SEQ ID NO:106, or the complement thereof; or comprises a guanine at a position corresponding to position 891 according to SEQ ID NO:107, or the complement thereof; b) labeling the amplified nucleic acid molecule with a detectable label; c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; lacking a CCAGTAG heptanucleotide at positions corresponding to positions 600-606 according to SEQ ID NO:34, or the complement thereof; comprising an adenine at a position corresponding to position 556 according to SEQ ID NO:36, or the complement thereof; comprising an adenine at a position corresponding to position 457 according to SEQ ID NO:41, or the complement thereof; comprising an adenine at a position corresponding to position 378 according to SEQ ID NO:46, or the complement thereof; comprising an adenine at a position corresponding to position 617 according to SEQ ID NO:51, or the complement thereof; comprising a thymine at a position corresponding to position 910 according to SEQ ID NO:37, or the complement thereof; comprising a thymine at a position corresponding to position 811 according to SEQ ID NO:42, or the complement thereof; comprising a thymine at a position corresponding to position 732 according to SEQ ID NO:47, or the complement thereof; comprising a thymine at a position corresponding to position 971 according to SEQ ID NO:52, or the complement thereof; lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; lacking an AAAG tetranucleotide at positions corresponding to positions 980-983 according to SEQ ID NO:34, or the complement thereof; comprising an insertion of a thymine at a position corresponding to position 1,410 according to SEQ ID NO:39, or the complement thereof; comprising an insertion of a thymine at a position corresponding to position 1,311 according to SEQ ID NO:44, or the complement thereof; comprising an insertion of a thymine at a position corresponding to position 1,232 according to SEQ ID NO:49, or the complement thereof; comprising an insertion of a thymine at a position corresponding to position 1,471 according to SEQ ID NO:54, or the complement thereof; comprising a guanine at a position corresponding to position 830 according to SEQ ID NO:104, or the complement thereof; comprising a guanine at a position corresponding to position 731 according to SEQ ID NO:105, or the complement thereof; comprising a guanine at a position corresponding to position 652 according to SEQ ID NO:106, or the complement thereof; or comprising a guanine at a position corresponding to position 891 according to SEQ ID NO:107, or the complement thereof; and d) detecting the detectable label.

In some embodiments, the nucleic acid molecule is mRNA and the determining step further comprises reverse-transcribing the mRNA into a cDNA prior to the amplifying step.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: i) lacking a CCAGTAG heptanucleotide at positions corresponding to positions 5,540-5,546 according to SEQ ID NO:1, or the complement thereof; ii) lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; or lacking a CCAGUAG heptanucleotide at positions corresponding to positions 600-606 according to SEQ ID NO:10, or the complement thereof; and/or iii) lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; or lacking a CCAGTAG heptanucleotide at positions corresponding to positions 600-606 according to SEQ ID NO:34, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: i) an adenine at a position corresponding to position 5,557 according to SEQ ID NO:3, or the complement thereof; ii) an adenine at a position corresponding to position 556 according to SEQ ID NO:12, or the complement thereof; an adenine at a position corresponding to position 457 according to SEQ ID NO:17, or the complement thereof; an adenine at a position corresponding to position 378 according to SEQ ID NO:22, or the complement thereof; or an adenine at a position corresponding to position 617 according to SEQ ID NO:27, or the complement thereof; and/or iii) an adenine at a position corresponding to position 556 according to SEQ ID NO:36, or the complement thereof; an adenine at a position corresponding to position 457 according to SEQ ID NO:41, or the complement thereof; an adenine at a position corresponding to position 378 according to SEQ ID NO:46, or the complement thereof; or an adenine at a position corresponding to position 617 according to SEQ ID NO:51, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: i) a thymine at a position corresponding to position 5,911 according to SEQ ID NO:4, or the complement thereof; ii) a uracil at a position corresponding to position 910 according to SEQ ID NO:13, or the complement thereof; a uracil at a position corresponding to position 811 according to SEQ ID NO:18, or the complement thereof; a uracil at a position corresponding to position 732 according to SEQ ID NO:23, or the complement thereof; a or uracil at a position corresponding to position 971 according to SEQ ID NO:28, or the complement thereof; and/or iii) a thymine at a position corresponding to position 910 according to SEQ ID NO:37, or the complement thereof; a thymine at a position corresponding to position 811 according to SEQ ID NO:42, or the complement thereof; a thymine at a position corresponding to position 732 according to SEQ ID NO:47, or the complement thereof; or a thymine at a position corresponding to position 971 according to SEQ ID NO:52, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: i) lacking an AAAG tetranucleotide at positions corresponding to positions 5,920-5,923 according to SEQ ID NO:1, or the complement thereof; ii) lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; or lacking an AAAG tetranucleotide at positions corresponding to positions 980-983 according to SEQ ID NO:10, or the complement thereof; and/or iii) lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; or lacking an AAAG tetranucleotide at positions corresponding to positions 980-983 according to SEQ ID NO:34, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: i) an insertion of a thymine at a position corresponding to position 6,411 according to SEQ ID NO:6, or the complement thereof; ii) an insertion of a uracil at a position corresponding to position 1,410 according to SEQ ID NO:15, or the complement thereof; an insertion of a uracil at a position corresponding to position 1,311 according to SEQ ID NO:20, or the complement thereof; an insertion of a uracil at a position corresponding to position 1,232 according to SEQ ID NO:25, or the complement thereof; or an insertion of a uracil at a position corresponding to position 1,471 according to SEQ ID NO:30, or the complement thereof; and/or iii) an insertion of a thymine at a position corresponding to position 1,410 according to SEQ ID NO:39, or the complement thereof; an insertion of a thymine at a position corresponding to position 1,311 according to SEQ ID NO:44, or the complement thereof; an insertion of a thymine at a position corresponding to position 1,232 according to SEQ ID NO:49, or the complement thereof; or an insertion of a thymine at a position corresponding to position 1,471 according to SEQ ID NO:54, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule comprising: i) a guanine at a position corresponding to position 5,831 according to SEQ ID NO:99, or the complement thereof; ii) a guanine at a position corresponding to position 830 according to SEQ ID NO:100, or the complement thereof; a guanine at a position corresponding to position 731 according to SEQ ID NO:101, or the complement thereof; a guanine at a position corresponding to position 652 according to SEQ ID NO:102, or the complement thereof; or a guanine at a position corresponding to position 891 according to SEQ ID NO:103, or the complement thereof; and/or iii) a guanine at a position corresponding to position 830 according to SEQ ID NO:104, or the complement thereof; a guanine at a position corresponding to position 731 according to SEQ ID NO:105, or the complement thereof; a guanine at a position corresponding to position 652 according to SEQ ID NO:106, or the complement thereof; or a guanine at a position corresponding to position 891 according to SEQ ID NO:107, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGTAG heptanucleotide at positions corresponding to positions 5,540-5,546 according to SEQ ID NO:2, or the complement thereof; comprising an adenine at a position corresponding to position 5,557 according to SEQ ID NO:3, or the complement thereof; comprising a thymine at a position corresponding to position 5,911 according to SEQ ID NO:4, or the complement thereof; lacking an AAAG tetranucleotide at positions corresponding to positions 5,920-5,923 according to SEQ ID NO:5, or the complement thereof; comprising an insertion of a thymine at a position corresponding to position 6,411 according to SEQ ID NO:6, or the complement thereof; or comprising a guanine at a position corresponding to position 5,831 according to SEQ ID NO:99, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; lacking a CCAGUAG heptanucleotide at positions corresponding to positions 600-606 according to SEQ ID NO:10, or the complement thereof; comprising an adenine at a position corresponding to position 556 according to SEQ ID NO:12, or the complement thereof; comprising an adenine at a position corresponding to position 457 according to SEQ ID NO:17, or the complement thereof; comprising an adenine at a position corresponding to position 378 according to SEQ ID NO:22, or the complement thereof; comprising an adenine at a position corresponding to position 617 according to SEQ ID NO:27, or the complement thereof; comprising a uracil at a position corresponding to position 910 according to SEQ ID NO:13, or the complement thereof; comprising a uracil at a position corresponding to position 811 according to SEQ ID NO:18, or the complement thereof; comprising a uracil at a position corresponding to position 732 according to SEQ ID NO:23, or the complement thereof; comprising a uracil at a position corresponding to position 971 according to SEQ ID NO:28, or the complement thereof; lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; lacking an AAAG tetranucleotide at positions corresponding to positions 980-983 according to SEQ ID NO:10, or the complement thereof; comprising an insertion of a uracil at a position corresponding to position 1,410 according to SEQ ID NO:15, or the complement thereof; comprising an insertion of a uracil at a position corresponding to position 1,311 according to SEQ ID NO:20, or the complement thereof; comprising an insertion of a uracil at a position corresponding to position 1,232 according to SEQ ID NO:25, or the complement thereof; comprising an insertion of a uracil at a position corresponding to position 1,471 according to SEQ ID NO:30, or the complement thereof; comprising a guanine at a position corresponding to position 830 according to SEQ ID NO:100, or the complement thereof; comprising a guanine at a position corresponding to position 731 according to SEQ ID NO:101, or the complement thereof; comprising a guanine at a position corresponding to position 652 according to SEQ ID NO:102, or the complement thereof; or comprising a guanine at a position corresponding to position 891 according to SEQ ID NO:103, or the complement thereof; and detecting the detectable label.

In some embodiments, the determining step, detecting step, or sequence analysis comprises: contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; lacking a CCAGTAG heptanucleotide at positions corresponding to positions 600-606 according to SEQ ID NO:34, or the complement thereof; comprising an adenine at a position corresponding to position 556 according to SEQ ID NO:36, or the complement thereof; comprising an adenine at a position corresponding to position 457 according to SEQ ID NO:41, or the complement thereof; comprising an adenine at a position corresponding to position 378 according to SEQ ID NO:46, or the complement thereof; comprising an adenine at a position corresponding to position 617 according to SEQ ID NO:51, or the complement thereof; comprising a thymine at a position corresponding to position 910 according to SEQ ID NO:37, or the complement thereof; comprising a thymine at a position corresponding to position 811 according to SEQ ID NO:42, or the complement thereof; comprising a thymine at a position corresponding to position 732 according to SEQ ID NO:47, or the complement thereof; comprising a thymine at a position corresponding to position 971 according to SEQ ID NO:52, or the complement thereof; lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; lacking an AAAG tetranucleotide at positions corresponding to positions 980-983 according to SEQ ID NO:34, or the complement thereof; comprising an insertion of a thymine at a position corresponding to position 1,410 according to SEQ ID NO:39, or the complement thereof; comprising an insertion of a thymine at a position corresponding to position 1,311 according to SEQ ID NO:44, or the complement thereof; comprising an insertion of a thymine at a position corresponding to position 1,232 according to SEQ ID NO:49, or the complement thereof; comprising an insertion of a thymine at a position corresponding to position 1,471 according to SEQ ID NO:54, or the complement thereof; comprising a guanine at a position corresponding to position 830 according to SEQ ID NO:104, or the complement thereof; comprising a guanine at a position corresponding to position 731 according to SEQ ID NO:105, or the complement thereof; comprising a guanine at a position corresponding to position 652 according to SEQ ID NO:106, or the complement thereof; or comprising a guanine at a position corresponding to position 891 according to SEQ ID NO:107, or the complement thereof; and detecting the detectable label.

Alteration-specific polymerase chain reaction techniques can be used to detect mutations such as SNPs in a nucleic acid sequence. Alteration-specific primers can be used because the DNA polymerase will not extend when a mismatch with the template is present.

In some embodiments, the nucleic acid molecule in the sample is mRNA and the mRNA is reverse-transcribed into a cDNA prior to the amplifying step. In some embodiments, the nucleic acid molecule is present within a cell obtained from the subject.

In some embodiments, the assay comprises contacting the biological sample with a primer or probe, such as an alteration-specific primer or alteration-specific probe, that specifically hybridizes to a GPR75 variant genomic sequence, variant mRNA sequence, or variant cDNA sequence and not the corresponding GPR75 reference sequence under stringent conditions, and determining whether hybridization has occurred.

In some embodiments, the assay comprises RNA sequencing (RNA-Seq). In some embodiments, the assays also comprise reverse transcribing mRNA into cDNA, such as by the reverse transcriptase polymerase chain reaction (RT-PCR).

In some embodiments, the methods utilize probes and primers of sufficient nucleotide length to bind to the target nucleotide sequence and specifically detect and/or identify a polynucleotide comprising a GPR75 variant genomic nucleic acid molecule, variant mRNA molecule, or variant cDNA molecule. The hybridization conditions or reaction conditions can be determined by the operator to achieve this result. The nucleotide length may be any length that is sufficient for use in a detection method of choice, including any assay described or exemplified herein. Such probes and primers can hybridize specifically to a target nucleotide sequence under high stringency hybridization conditions. Probes and primers may have complete nucleotide sequence identity of contiguous nucleotides within the target nucleotide sequence, although probes differing from the target nucleotide sequence and that retain the ability to specifically detect and/or identify a target nucleotide sequence may be designed by conventional methods. Probes and primers can have about 80%, about 85%, about 90%, about 91%, about 92%, about 93%, about 94%, about 95%, about 96%, about 97%, about 98%, about 99%, or 100% sequence identity or complementarity with the nucleotide sequence of the target nucleic acid molecule.

In some embodiments, to determine whether a GPR75 nucleic acid molecule (genomic nucleic acid molecule, mRNA molecule, or cDNA molecule), or complement thereof, within a biological sample comprises a nucleotide sequence lacking a CCAGTAG heptanucleotide at positions corresponding to positions 5,540-5,546 according to SEQ ID NO:1 (genomic nucleic acid molecule), a deletion of a CCAGUAG heptanucleotide at positions corresponding to positions 539-545 according to SEQ ID NO:7; a deletion of a CCAGUAG heptanucleotide at positions corresponding to positions 440-446 according to SEQ ID NO:8; a deletion of a CCAGUAG heptanucleotide at positions corresponding to positions 361-367 according to SEQ ID NO:9; or a deletion of a CCAGUAG heptanucleotide at positions corresponding to positions 600-606 according to SEQ ID NO:10 (for mRNA molecules); a deletion of a CCAGTAG heptanucleotide at positions corresponding to positions 539-545 according to SEQ ID NO:31; a deletion of a CCAGTAG heptanucleotide at positions corresponding to positions 440-446 according to SEQ ID NO:32; a deletion of a CCAGTAG heptanucleotide at positions corresponding to positions 361-367 according to SEQ ID NO:33; or a deletion of a CCAGTAG heptanucleotide at positions corresponding to positions 600-606 according to SEQ ID NO:34 (for cDNA molecules), the biological sample can be subjected to an amplification method using a primer pair that includes a first primer derived from the 5' flanking sequence adjacent to a deletion of a CCAGTAG heptanucleotide at positions corresponding to positions 5,540-5,546 according to SEQ ID NO:1, a deletion of a CCAGUAG heptanucleotide at positions corresponding to positions 539-545 according to SEQ ID NO:7, a deletion of a CCAGUAG heptanucleotide at positions corresponding to positions 440-446 according to SEQ ID NO:8, a deletion of a CCAGUAG heptanucleotide at positions corresponding to positions 361-367 according to SEQ ID NO:9, a deletion of a CCAGUAG heptanucleotide at positions corresponding to positions 600-606 according to SEQ ID NO:10, a deletion of a CCAGTAG heptanucleotide at positions corresponding to positions 539-545 according to SEQ ID NO:31, a deletion of a CCAGTAG heptanucleotide at positions corresponding to positions 440-446 according to SEQ ID NO:32, a deletion of a CCAGTAG heptanucleotide at positions corresponding to positions 361-367 according to SEQ ID NO:33, or a deletion of a CCAGTAG heptanucleotide at positions corresponding to positions 600-606 according to SEQ ID NO:34, and a second primer derived from the 3' flanking sequence adjacent to a deletion of a CCAGTAG heptanucleotide at positions corresponding to positions 5,540-5,546 according to SEQ ID NO:1, a deletion of a CCAGUAG heptanucleotide at positions corresponding to positions 539-545 according to SEQ ID NO:7, a deletion of a CCAGUAG heptanucleotide at positions corresponding to positions 440-446 according to SEQ ID NO:8, a deletion of a CCAGUAG heptanucleotide at positions corresponding to positions 361-367 according to SEQ ID NO:9, a deletion of a CCAGUAG heptanucleotide at positions corresponding to positions 600-606 according to SEQ ID NO:10, a deletion of a CCAGTAG heptanucleotide at positions corresponding to positions 539-545 according to SEQ ID NO:31, a deletion of a CCAGTAG heptanucleotide at positions corresponding to positions 440-446 according to SEQ ID NO:32, a deletion of a CCAGTAG heptanucleotide at positions corresponding to positions 361-367 according to SEQ ID NO:33, or a deletion of a CCAGTAG heptanucleotide at positions corresponding to positions 600-606 according to SEQ ID NO:34, to produce an amplicon that is indicative of the presence of a deletion of a CCAGTAG heptanucleotide at positions corresponding to positions 5,540-5,546 according to SEQ ID NO:1, a deletion of a CCAGUAG heptanucleotide at positions corresponding to positions 539-545 according to SEQ ID NO:7, a deletion of a CCAGUAG heptanucleotide at positions corresponding to positions 440-446 according to SEQ ID NO:8, a deletion of a CCAGUAG heptanucleotide at positions corresponding to positions 361-367 according to SEQ ID NO:9, a deletion of a CCAGUAG heptanucleotide at positions corresponding to positions 600-606 according to SEQ ID NO:10, a deletion of a CCAGTAG heptanucleotide at positions corresponding to positions 539-545 according to SEQ ID NO:31, a deletion of a CCAGTAG heptanucleotide at positions corresponding to positions 440-446 according to SEQ ID NO:32, a deletion of a CCAGTAG heptanucleotide at positions corresponding to positions 361-367 according to SEQ ID NO:33, or a deletion of a CCAGTAG heptanucleotide at positions corresponding to positions 600-606 according to SEQ ID NO:34. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions lacking a CCAGTAG heptanucleotide at positions corresponding to positions 5,540-5,546 according to SEQ ID NO:1, a deletion of a CCAGUAG heptanucleotide at positions corresponding to positions 539-545 according to SEQ ID NO:7, a deletion of a CCAGUAG heptanucleotide at positions corresponding to positions 440-446 according to SEQ ID NO:8, a deletion of a CCAGUAG heptanucleotide at positions corresponding to positions 361-367 according to SEQ ID NO:9, a deletion of a CCAGUAG heptanucleotide at positions corresponding to positions 600-606 according to SEQ ID NO:10, a deletion of a CCAGTAG heptanucleotide at positions corresponding to positions 539-545 according to SEQ ID NO:31, a deletion of a CCAGTAG heptanucleotide at positions corresponding to positions 440-446 according to SEQ ID NO:32, a deletion of a CCAGTAG heptanucleotide at positions corresponding to positions 361-367 according to SEQ ID NO:33, or a deletion of a CCAGTAG heptanucleotide at positions corresponding to positions 600-606 according to SEQ ID NO:34, and at least 1, 2, 3, 4, 5, 6, 7, 8, 9, 10, or more nucleotides on each side of positions lacking a CCAGTAG heptanucleotide at positions corresponding to positions 5,540-5,546 according to SEQ ID NO:1, a deletion of a CCAGUAG heptanucleotide at positions corresponding to positions 539-545 according to SEQ ID NO:7, a deletion of a CCAGUAG heptanucleotide at positions corresponding to positions 440-446 according to SEQ ID NO:8, a deletion of a CCAGUAG heptanucleotide at positions corresponding to positions 361-367 according to SEQ ID NO:9, a deletion of a CCAGUAG heptanucleotide at positions corresponding to positions 600-606 according to SEQ ID NO:10, a deletion of a CCAGTAG heptanucleotide at positions corresponding to positions 539-545 according to SEQ ID NO:31, a deletion of a CCAGTAG heptanucleotide at positions corresponding to positions 440-446 according to SEQ ID NO:32, a deletion of a CCAGTAG heptanucleotide at positions corresponding to positions 361-367 according to SEQ ID NO:33, or a deletion of a CCAGTAG heptanucleotide at positions corresponding to positions 600-606 according to SEQ ID NO:34.

In some embodiments, to determine whether a GPR75 nucleic acid molecule (genomic nucleic acid molecule, mRNA molecule, or cDNA molecule), or complement thereof, within a biological sample comprises a nucleotide sequence comprising an adenine at a position corresponding to position 5,557 according to SEQ ID NO:3 (genomic nucleic acid molecule), an adenine at a position corresponding to position 556 according to SEQ ID NO:12; an adenine at a position corresponding to position 457 according to SEQ ID NO:17; an adenine at a position corresponding to position 378 according to SEQ ID NO:22; or an adenine at a position corresponding to position 617 according to SEQ ID NO:27 (for mRNA molecules); an adenine at a position corresponding to position 556 according to SEQ ID NO:36; an adenine at a position corresponding to position 457 according to SEQ ID NO:41; an adenine at a position corresponding to position 378 according to SEQ ID NO:46; or an adenine at a position corresponding to position 617 according to SEQ ID NO:51 (for cDNA molecules), the biological sample can be subjected to an amplification method using a primer pair that includes a first primer derived from the 5' flanking sequence adjacent to an adenine at a position corresponding to position 5,557 according to SEQ ID NO:3, an adenine at a position corresponding to position 556 according to SEQ ID NO:12, an adenine at a position corresponding to position 457 according to SEQ ID NO:17, an adenine at a position corresponding to position 378 according to SEQ ID NO:22, an adenine at a position corresponding to position 617 according to SEQ ID NO:27, an adenine at a position corresponding to position 556 according to SEQ ID NO:36, an adenine at a position corresponding to position 457 according to SEQ ID NO:41, an adenine at a position corresponding to position 378 according to SEQ ID NO:46, or an adenine at a position corresponding to position 617 according to SEQ ID NO:51, and a second primer derived from the 3' flanking sequence adjacent to an adenine at a position corresponding to position 5,557 according to SEQ ID NO:3, an adenine at a position corresponding to position 556 according to SEQ ID NO:12, an adenine at a position corresponding to position 457 according to SEQ ID NO:17, an adenine at a position corresponding to position 378 according to SEQ ID NO:22, an adenine at a position corresponding to position 617 according to SEQ ID NO:27, an adenine at a position corresponding to position 556 according to SEQ ID NO:36, an adenine at a position corresponding to position 457 according to SEQ ID NO:41, an adenine at a position corresponding to position 378 according to SEQ ID NO:46, or an adenine at a position corresponding to position 617 according to SEQ ID NO:51 to produce an amplicon that is indicative of the presence of the SNP at positions encoding an adenine at a position corresponding to position 5,557 according to SEQ ID NO:3, an adenine at a position corresponding to position 556 according to SEQ ID NO:12, an adenine at a position corresponding to position 457 according to SEQ ID NO:17, an adenine at a position corresponding to position 378 according to SEQ ID NO:22, an adenine at a position corresponding to position 617 according to SEQ ID NO:27, an adenine at a position corresponding to position 556 according to SEQ ID NO:36, an adenine at a position corresponding to position 457 according to SEQ ID NO:41, an adenine at a position corresponding to position 378 according to SEQ ID NO:46, or an adenine at a position corresponding to position 617 according to SEQ ID NO:51. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising an adenine at a position corresponding to position 5,557 according to SEQ ID NO:3, an adenine at a position corresponding to position 556 according to SEQ ID NO:12, an adenine at a position corresponding to position 457 according to SEQ ID NO:17, an adenine at a position corresponding to position 378 according to SEQ ID NO:22, an adenine at a position corresponding to position 617 according to SEQ ID NO:27, an adenine at a position corresponding to position 556 according to SEQ ID NO:36, an adenine at a position corresponding to position 457 according to SEQ ID NO:41, an adenine at a position corresponding to position 378 according to SEQ ID NO:46, or an adenine at a position corresponding to position 617 according to SEQ ID NO:51, and at least 1, 2, 3, 4, 5, 6, 7, 8, 9, 10, or more nucleotides on each side of positions comprising an adenine at a position corresponding to position 5,557 according to SEQ ID NO:3, an adenine at a position corresponding to position 556 according to SEQ ID NO:12, an adenine at a position corresponding to position 457 according to SEQ ID NO:17, an adenine at a position corresponding to position 378 according to SEQ ID NO:22, an adenine at a position corresponding to position 617 according to SEQ ID NO:27, an adenine at a position corresponding to position 556 according to SEQ ID NO:36, an adenine at a position corresponding to position 457 according to SEQ ID NO:41, an adenine at a position corresponding to position 378 according to SEQ ID NO:46, or an adenine at a position corresponding to position 617 according to SEQ ID NO:51.

In some embodiments, to determine whether a GPR75 nucleic acid molecule (genomic nucleic acid molecule, mRNA molecule, or cDNA molecule), or complement thereof, within a biological sample comprises a nucleotide sequence comprising a thymine at a position corresponding to position 5,911 according to SEQ ID NO:4 (genomic nucleic acid molecule), a uracil at a position corresponding to position 910 according to SEQ ID NO:13; a uracil at a position corresponding to position 811 according to SEQ ID NO:18; a uracil at a position corresponding to position 732 according to SEQ ID NO:23; or a uracil at a position corresponding to position 971 according to SEQ ID NO:28 (for mRNA molecules); a thymine at a position corresponding to position 910 according to SEQ ID NO:37; a thymine at a position corresponding to position 811 according to SEQ ID NO:42; a thymine at a position corresponding to position 732 according to SEQ ID NO:47; or a thymine at a position corresponding to position 971 according to SEQ ID NO:52 (for cDNA molecules), the biological sample can be subjected to an amplification method using a primer pair that includes a first primer derived from the 5' flanking sequence adjacent to a thymine at a position corresponding to position 5,911 according to SEQ ID NO:4, a uracil at a position corresponding to position 910 according to SEQ ID NO:13, a uracil at a position corresponding to position 811 according to SEQ ID NO:18, a uracil at a position corresponding to position 732 according to SEQ ID NO:23, a uracil at a position corresponding to position 971 according to SEQ ID NO:28, a thymine at a position corresponding to position 910 according to SEQ ID NO:37, a thymine at a position corresponding to position 811 according to SEQ ID NO:42, a thymine at a position corresponding to position 732 according to SEQ ID NO:47, or a thymine at a position corresponding to position 971 according to SEQ ID NO:52, and a second primer derived from the 3' flanking sequence adjacent to a thymine at a position corresponding to position 5,911 according to SEQ ID NO:4, a uracil at a position corresponding to position 910 according to SEQ ID NO:13, a uracil at a position corresponding to position 811 according to SEQ ID NO:18, a uracil at a position corresponding to position 732 according to SEQ ID NO:23, a uracil at a position corresponding to position 971 according to SEQ ID NO:28, a thymine at a position corresponding to position 910 according to SEQ ID NO:37, a thymine at a position corresponding to position 811 according to SEQ ID NO:42, a thymine at a position corresponding to position 732 according to SEQ ID NO:47, or a thymine at a position corresponding to position 971 according to SEQ ID NO:52 to produce an amplicon that is indicative of the presence of the SNP at positions encoding a thymine at a position corresponding to position 5,911 according to SEQ ID NO:4, a uracil at a position corresponding to position 910 according to SEQ ID NO:13, a uracil at a position corresponding to position 811 according to SEQ ID NO:18, a uracil at a position corresponding to position 732 according to SEQ ID NO:23, a uracil at a position corresponding to position 971 according to SEQ ID NO:28, a thymine at a position corresponding to position 910 according to SEQ ID NO:37, a thymine at a position corresponding to position 811 according to SEQ ID NO:42, a thymine at a position corresponding to position 732 according to SEQ ID NO:47, or a thymine at a position corresponding to position 971 according to SEQ ID NO:52. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising a thymine at a position corresponding to position 5,911 according to SEQ ID NO:4, a uracil at a position corresponding to position 910 according to SEQ ID NO:13, a uracil at a position corresponding to position 811 according to SEQ ID NO:18, a uracil at a position corresponding to position 732 according to SEQ ID NO:23, a uracil at a position corresponding to position 971 according to SEQ ID NO:28, a thymine at a position corresponding to position 910 according to SEQ ID NO:37, a thymine at a position corresponding to position 811 according to SEQ ID NO:42, a thymine at a position corresponding to position 732 according to SEQ ID NO:47, or a thymine at a position corresponding to position 971 according to SEQ ID NO:52, and at least 1, 2, 3, 4, 5, 6, 7, 8, 9, 10, or more nucleotides on each side of positions comprising a thymine at a position corresponding to position 5,911 according to SEQ ID NO:4, a uracil at a position corresponding to position 910 according to SEQ ID NO:13, a uracil at a position corresponding to position 811 according to SEQ ID NO:18, a uracil at a position corresponding to position 732 according to SEQ ID NO:23, a uracil at a position corresponding to position 971 according to SEQ ID NO:28, a thymine at a position corresponding to position 910 according to SEQ ID NO:37, a thymine at a position corresponding to position 811 according to SEQ ID NO:42, a thymine at a position corresponding to position 732 according to SEQ ID NO:47, or a thymine at a position corresponding to position 971 according to SEQ ID NO:52.

In some embodiments, to determine whether a GPR75 nucleic acid molecule (genomic nucleic acid molecule, mRNA molecule, or cDNA molecule), or complement thereof, within a biological sample comprises a nucleotide sequence lacking an AAAG tetranucleotide at positions corresponding to positions 5,920-5,923 according to SEQ ID NO:1 (genomic nucleic acid molecule), a deletion of an AAAG tetranucleotide at positions corresponding to positions 919-922 according to SEQ ID NO:7; a deletion of an AAAG tetranucleotide at positions corresponding to positions 820-823 according to SEQ ID NO:8; a deletion of an AAAG tetranucleotide at positions corresponding to positions 741-744 according to SEQ ID NO:9; or a deletion of an AAAG tetranucleotide at positions corresponding to positions 980-983 according to SEQ ID NO:10 (for mRNA molecules); a deletion of an AAAG tetranucleotide at positions corresponding to positions 919-922 according to SEQ ID NO:31; a deletion of an AAAG tetranucleotide at positions corresponding to positions 820-823 according to SEQ ID NO:32; a deletion of an AAAG tetranucleotide at positions corresponding to positions 741-744 according to SEQ ID NO:33; or a deletion of an AAAG tetranucleotide at positions corresponding to positions 980-983 according to SEQ ID NO:34 (for cDNA molecules), the biological sample can be subjected to an amplification method using a primer pair that includes a first primer derived from the 5' flanking sequence adjacent to a deletion of an AAAG tetranucleotide at positions corresponding to positions 5,920-5,923 according to SEQ ID NO:1, a deletion of an AAAG tetranucleotide at positions corresponding to positions 919-922 according to SEQ ID NO:7, a deletion of an AAAG tetranucleotide at positions corresponding to positions 820-823 according to SEQ ID NO:8, a deletion of an AAAG tetranucleotide at positions corresponding to positions 741-744 according to SEQ ID NO:9, a deletion of an AAAG tetranucleotide at positions corresponding to positions 980-983 according to SEQ ID NO:10, a deletion of an AAAG tetranucleotide at positions corresponding to positions 919-922 according to SEQ ID NO:31, a deletion of an AAAG tetranucleotide at positions corresponding to positions 820-823 according to SEQ ID NO:32, a deletion of an AAAG tetranucleotide at positions corresponding to positions 741-744 according to SEQ ID NO:33, or a deletion of an AAAG tetranucleotide at positions corresponding to positions 980-983 according to SEQ ID NO:34, and a second primer derived from the 3' flanking sequence adjacent to a deletion of an AAAG tetranucleotide at positions corresponding to positions 5,920-5,923 according to SEQ ID NO:1, a deletion of an AAAG tetranucleotide at positions corresponding to positions 919-922 according to SEQ ID NO:7, a deletion of an AAAG tetranucleotide at positions corresponding to positions 820-823 according to SEQ ID NO:8, a deletion of an AAAG tetranucleotide at positions corresponding to positions 741-744 according to SEQ ID NO:9, a deletion of an AAAG tetranucleotide at positions corresponding to positions 980-983 according to SEQ ID NO:10, a deletion of an AAAG tetranucleotide at positions corresponding to positions 919-922 according to SEQ ID NO:31, a deletion of an AAAG tetranucleotide at positions corresponding to positions 820-823 according to SEQ ID NO:32, a deletion of an AAAG tetranucleotide at positions corresponding to positions 741-744 according to SEQ ID NO:33, or a deletion of an AAAG tetranucleotide at positions corresponding to positions 980-983 according to SEQ ID NO:34 to produce an amplicon that is indicative of the presence of a deletion of an AAAG tetranucleotide at positions corresponding to positions 5,920-5,923 according to SEQ ID NO:1, a deletion of an AAAG tetranucleotide at positions corresponding to positions 919-922 according to SEQ ID NO:7, a deletion of an AAAG tetranucleotide at positions corresponding to positions 820-823 according to SEQ ID NO:8, a deletion of an AAAG tetranucleotide at positions corresponding to positions 741-744 according to SEQ ID NO:9, a deletion of an AAAG tetranucleotide at positions corresponding to positions 980-983 according to SEQ ID NO:10, a deletion of an AAAG tetranucleotide at positions corresponding to positions 919-922 according to SEQ ID NO:31, a deletion of an AAAG tetranucleotide at positions corresponding to positions 820-823 according to SEQ ID NO:32, a deletion of an AAAG tetranucleotide at positions corresponding to positions 741-744 according to SEQ ID NO:33, or a deletion of an AAAG tetranucleotide at positions corresponding to positions 980-983 according to SEQ ID NO:34. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions lacking an AAAG tetranucleotide at positions corresponding to positions 5,920-5,923 according to SEQ ID NO:1, a deletion of an AAAG tetranucleotide at positions corresponding to positions 919-922 according to SEQ ID NO:7, a deletion of an AAAG tetranucleotide at positions corresponding to positions 820-823 according to SEQ ID NO:8, a deletion of an AAAG tetranucleotide at positions corresponding to positions 741-744 according to SEQ ID NO:9, a deletion of an AAAG tetranucleotide at positions corresponding to positions 980-983 according to SEQ ID NO:10, a deletion of an AAAG tetranucleotide at positions corresponding to positions 919-922 according to SEQ ID NO:31, a deletion of an AAAG tetranucleotide at positions corresponding to positions 820-823 according to SEQ ID NO:32, a deletion of an AAAG tetranucleotide at positions corresponding to positions 741-744 according to SEQ ID NO:33, or a deletion of an AAAG tetranucleotide at positions corresponding to positions 980-983 according to SEQ ID NO:34, and at least 1, 2, 3, 4, 5, 6, 7, 8, 9, 10, or more nucleotides on each side of positions lacking an AAAG tetranucleotide at positions corresponding to positions 5,920-5,923 according to SEQ ID NO:1, a deletion of an AAAG tetranucleotide at positions corresponding to positions 919-922 according to SEQ ID NO:7, a deletion of an AAAG tetranucleotide at positions corresponding to positions 820-823 according to SEQ ID NO:8, a deletion of an AAAG tetranucleotide at positions corresponding to positions 741-744 according to SEQ ID NO:9, a deletion of an AAAG tetranucleotide at positions corresponding to positions 980-983 according to SEQ ID NO:10, a deletion of an AAAG tetranucleotide at positions corresponding to positions 919-922 according to SEQ ID NO:31, a deletion of an AAAG tetranucleotide at positions corresponding to positions 820-823 according to SEQ ID NO:32, a deletion of an AAAG tetranucleotide at positions corresponding to positions 741-744 according to SEQ ID NO:33, or a deletion of an AAAG tetranucleotide at positions corresponding to positions 980-983 according to SEQ ID NO:34.

In some embodiments, to determine whether a GPR75 nucleic acid molecule (genomic nucleic acid molecule, mRNA molecule, or cDNA molecule), or complement thereof, within a biological sample comprises a nucleotide sequence comprising an insertion of a thymine at a position corresponding to position 6,411 according to SEQ ID NO:6 (genomic nucleic acid molecule), an insertion of a uracil at a position corresponding to position 1,410 according to SEQ ID NO:15; an insertion of a uracil at a position corresponding to position 1,311 according to SEQ ID NO:20; an insertion of a uracil at a position corresponding to position 1,232 according to SEQ ID NO:25; or an insertion of a uracil at a position corresponding to position 1,471 according to SEQ ID NO:30 (for mRNA molecules); an insertion of a thymine at a position corresponding to position 1,410 according to SEQ ID NO:39; an insertion of a thymine at a position corresponding to position 1,311 according to SEQ ID NO:44; an insertion of a thymine at a position corresponding to position 1,232 according to SEQ ID NO:49; or an insertion of a thymine at a position corresponding to position 1,471 according to SEQ ID NO:54 (for cDNA molecules), the biological sample can be subjected to an amplification method using a primer pair that includes a first primer derived from the 5' flanking sequence adjacent to an insertion of a thymine at a position corresponding to position 6,411 according to SEQ ID NO:6, an insertion of a uracil at a position corresponding to position 1,410 according to SEQ ID NO:15, an insertion of a uracil at a position corresponding to position 1,311 according to SEQ ID NO:20, an insertion of a uracil at a position corresponding to position 1,232 according to SEQ ID NO:25, an insertion of a uracil at a position corresponding to position 1,471 according to SEQ ID NO:30, an insertion of a thymine at a position corresponding to position 1,410 according to SEQ ID NO:39, an insertion of a thymine at a position corresponding to position 1,311 according to SEQ ID NO:44, an insertion of a thymine at a position corresponding to position 1,232 according to SEQ ID NO:49, or an insertion of a thymine at a position corresponding to position 1,471 according to SEQ ID NO:54, and a second primer derived from the 3' flanking sequence adjacent to an insertion of a thymine at a position corresponding to position 6,411 according to SEQ ID NO:6, an insertion of a uracil at a position corresponding to position 1,410 according to SEQ ID NO:15, an insertion of a uracil at a position corresponding to position 1,311 according to SEQ ID NO:20, an insertion of a uracil at a position corresponding to position 1,232 according to SEQ ID NO:25, an insertion of a uracil at a position corresponding to position 1,471 according to SEQ ID NO:30, an insertion of a thymine at a position corresponding to position 1,410 according to SEQ ID NO:39, an insertion of a thymine at a position corresponding to position 1,311 according to SEQ ID NO:44, an insertion of a thymine at a position corresponding to position 1,232 according to SEQ ID NO:49, or an insertion of a thymine at a position corresponding to position 1,471 according to SEQ ID NO:54 to produce an amplicon that is indicative of the presence of an insertion of a thymine at a position corresponding to position 6,411 according to SEQ ID NO:6, an insertion of a uracil at a position corresponding to position 1,410 according to SEQ ID NO:15, an insertion of a uracil at a position corresponding to position 1,311 according to SEQ ID NO:20, an insertion of a uracil at a position corresponding to position 1,232 according to SEQ ID NO:25, an insertion of a uracil at a position corresponding to position 1,471 according to SEQ ID NO:30, an insertion of a thymine at a position corresponding to position 1,410 according to SEQ ID NO:39, an insertion of a thymine at a position corresponding to position 1,311 according to SEQ ID NO:44, an insertion of a thymine at a position corresponding to position 1,232 according to SEQ ID NO:49, or an insertion of a thymine at a position corresponding to position 1,471 according to SEQ ID NO:54. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising an insertion of a thymine at a position corresponding to position 6,411 according to SEQ ID NO:6, an insertion of a uracil at a position corresponding to position 1,410 according to SEQ ID NO:15, an insertion of a uracil at a position corresponding to position 1,311 according to SEQ ID NO:20, an insertion of a uracil at a position corresponding to position 1,232 according to SEQ ID NO:25, an insertion of a uracil at a position corresponding to position 1,471 according to SEQ ID NO:30, an insertion of a thymine at a position corresponding to position 1,410 according to SEQ ID NO:39, an insertion of a thymine at a position corresponding to position 1,311 according to SEQ ID NO:44, an insertion of a thymine at a position corresponding to position 1,232 according to SEQ ID NO:49, or an insertion of a thymine at a position corresponding to position 1,471 according to SEQ ID NO:54, and at least 1, 2, 3, 4, 5, 6, 7, 8, 9, 10, or more nucleotides on each side of positions comprising an insertion of a thymine at a position corresponding to position 6,411 according to SEQ ID NO:6, an insertion of a uracil at a position corresponding to position 1,410 according to SEQ ID NO:15, an insertion of a uracil at a position corresponding to position 1,311 according to SEQ ID NO:20, an insertion of a uracil at a position corresponding to position 1,232 according to SEQ ID NO:25, an insertion of a uracil at a position corresponding to position 1,471 according to SEQ ID NO:30, an insertion of a thymine at a position corresponding to position 1,410 according to SEQ ID NO:39, an insertion of a thymine at a position corresponding to position 1,311 according to SEQ ID NO:44, an insertion of a thymine at a position corresponding to position 1,232 according to SEQ ID NO:49, or an insertion of a thymine at a position corresponding to position 1,471 according to SEQ ID NO:54.

In some embodiments, to determine whether a GPR75 nucleic acid molecule (genomic nucleic acid molecule, mRNA molecule, or cDNA molecule), or complement thereof, within a biological sample comprises a nucleotide sequence comprising a guanine at a position corresponding to position 5,831 according to SEQ ID NO:99 (genomic nucleic acid molecule), a guanine at a position corresponding to position 830 according to SEQ ID NO:100, a guanine at a position corresponding to position 731 according to SEQ ID NO:101, a guanine at a position corresponding to position 652 according to SEQ ID NO:102, or a guanine at a position corresponding to position 891 according to SEQ ID NO:103, (for mRNA molecules); a guanine at a position corresponding to position 830 according to SEQ ID NO:104, a guanine at a position corresponding to position 731 according to SEQ ID NO:105, a guanine at a position corresponding to position 652 according to SEQ ID NO:106, or a guanine at a position corresponding to position 891 according to SEQ ID NO:107 (for cDNA molecules), the biological sample can be subjected to an amplification method using a primer pair that includes a first primer derived from the 5' flanking sequence adjacent to guanine at a position corresponding to position 5,831 according to SEQ ID NO:99, a guanine at a position corresponding to position 830 according to SEQ ID NO:100, a guanine at a position corresponding to position 731 according to SEQ ID NO:101, a guanine at a position corresponding to position 652 according to SEQ ID NO:102, a guanine at a position corresponding to position 891 according to SEQ ID NO:103, a guanine at a position corresponding to position 830 according to SEQ ID NO:104, a guanine at a position corresponding to position 731 according to SEQ ID NO:105, a guanine at a position corresponding to position 652 according to SEQ ID NO:106, or a guanine at a position corresponding to position 891 according to SEQ ID NO:107, and a second primer derived from the 3' flanking sequence adjacent to guanine at a position corresponding to position 5,831 according to SEQ ID NO:99, a guanine at a position corresponding to position 830 according to SEQ ID NO:100, a guanine at a position corresponding to position 731 according to SEQ ID NO:101, a guanine at a position corresponding to position 652 according to SEQ ID NO:102, a guanine at a position corresponding to position 891 according to SEQ ID NO:103, a guanine at a position corresponding to position 830 according to SEQ ID NO:104, a guanine at a position corresponding to position 731 according to SEQ ID NO:105, a guanine at a position corresponding to position 652 according to SEQ ID NO:106, or a guanine at a position corresponding to position 891 according to SEQ ID NO:107, to produce an amplicon that is indicative of the presence of an insertion of guanine at a position corresponding to position 5,831 according to SEQ ID NO:99, a guanine at a position corresponding to position 830 according to SEQ ID NO:100, a guanine at a position corresponding to position 731 according to SEQ ID NO:101, a guanine at a position corresponding to position 652 according to SEQ ID NO:102, a guanine at a position corresponding to position 891 according to SEQ ID NO:103, a guanine at a position corresponding to position 830 according to SEQ ID NO:104, a guanine at a position corresponding to position 731 according to SEQ ID NO:105, a guanine at a position corresponding to position 652 according to SEQ ID NO:106, or a guanine at a position corresponding to position 891 according to SEQ ID NO:107. In some embodiments, the amplicon may range in length from the combined length of the primer pairs plus one nucleotide base pair to any length of amplicon producible by a DNA amplification protocol. This distance can range from one nucleotide base pair up to the limits of the amplification reaction, or about twenty thousand nucleotide base pairs. Optionally, the primer pair flanks a region including positions comprising an insertion of guanine at a position corresponding to position 5,831 according to SEQ ID NO:99, a guanine at a position corresponding to position 830 according to SEQ ID NO:100, a guanine at a position corresponding to position 731 according to SEQ ID NO:101, a guanine at a position corresponding to position 652 according to SEQ ID NO:102, a guanine at a position corresponding to position 891 according to SEQ ID NO:103, a guanine at a position corresponding to position 830 according to SEQ ID NO:104, a guanine at a position corresponding to position 731 according to SEQ ID NO:105, a guanine at a position corresponding to position 652 according to SEQ ID NO:106, or a guanine at a position corresponding to position 891 according to SEQ ID NO:107, and at least 1, 2, 3, 4, 5, 6, 7, 8, 9, 10, or more nucleotides on each side of positions comprising a guanine at a position corresponding to position 5,831 according to SEQ ID NO:99, a guanine at a position corresponding to position 830 according to SEQ ID NO:100, a guanine at a position corresponding to position 731 according to SEQ ID NO:101, a guanine at a position corresponding to position 652 according to SEQ ID NO:102, a guanine at a position corresponding to position 891 according to SEQ ID NO:103, a guanine at a position corresponding to position 830 according to SEQ ID NO:104, a guanine at a position corresponding to position 731 according to SEQ ID NO:105, a guanine at a position corresponding to position 652 according to SEQ ID NO:106, or a guanine at a position corresponding to position 891 according to SEQ ID NO:107.

Similar amplicons can be generated from the mRNA and/or cDNA sequences. PCR primer pairs can be derived from a known sequence, for example, by using computer programs intended for that purpose, such as the PCR primer analysis tool in Vector NTI version 10 (Informax Inc., Bethesda Md.); PrimerSelect (DNASTAR Inc., Madison, Wis.); and Primer3 (Version 0.4.0.COPYRGT., 1991, Whitehead Institute for Biomedical Research, Cambridge, Mass.). Additionally, the sequence can be visually scanned and primers manually identified using known guidelines.

Illustrative examples of nucleic acid sequencing techniques include, but are not limited to, chain terminator (Sanger) sequencing and dye terminator sequencing. Other methods involve nucleic acid hybridization methods other than sequencing, including using labeled primers or probes directed against purified DNA, amplified DNA, and fixed cell preparations (fluorescence in situ hybridization (FISH)). In some methods, a target nucleic acid molecule may be amplified prior to simultaneous with detection. Illustrative examples of nucleic acid amplification techniques include, but are not limited to, polymerase chain reaction (PCR), ligase chain reaction (LCR), strand displacement amplification (SDA), and nucleic acid sequence based amplification (NASBA). Other methods include, but are not limited to, ligase chain reaction, strand displacement amplification, and thermophilic SDA (tSDA).

In hybridization techniques, stringent conditions can be employed such that a probe or primer will specifically hybridize to its target. In some embodiments, a polynucleotide primer or probe under stringent conditions will hybridize to its target sequence to a detectably greater degree than to other non-target sequences, such as, at least 2-fold, at least 3-fold, at least 4-fold, or more over background, including over 10-fold over background. In some embodiments, a polynucleotide primer or probe under stringent conditions will hybridize to its target nucleotide sequence to a detectably greater degree than to other nucleotide sequences by at least 2-fold. In some embodiments, a polynucleotide primer or probe under stringent conditions will hybridize to its target nucleotide sequence to a detectably greater degree than to other nucleotide sequences by at least 3-fold. In some embodiments, a polynucleotide primer or probe under stringent conditions will hybridize to its target nucleotide sequence to a detectably greater degree than to other nucleotide sequences by at least 4-fold. In some embodiments, a polynucleotide primer or probe under stringent conditions will hybridize to its target nucleotide sequence to a detectably greater degree than to other nucleotide sequences by over 10-fold over background. Stringent conditions are sequence-dependent and will be different in different circumstances.

Appropriate stringency conditions which promote DNA hybridization, for example, 6× sodium chloride/sodium citrate (SSC) at about 45° C., followed by a wash of 2×SSC at 50° C., are known or can be found in *Current Protocols in Molecular Biology*, John Wiley & Sons, N.Y. (1989), 6.3.1-6.3.6. Typically, stringent conditions for hybridization and detection will be those in which the salt concentration is less than about 1.5 M Na$^+$ ion, typically about 0.01 to 1.0 M Na$^+$ ion concentration (or other salts) at pH 7.0 to 8.3 and the temperature is at least about 30° C. for short probes (such as, for example, 10 to 50 nucleotides) and at least about 60° C. for longer probes (such as, for example, greater than 50 nucleotides). Stringent conditions may also be achieved with the addition of destabilizing agents such as formamide. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

The present disclosure also provides methods of detecting the presence of a human GPR75 predicted loss-of-function polypeptide comprising performing an assay on a biological sample obtained from a subject to determine whether a GPR75 polypeptide in the subject contains one or more variations that causes the polypeptide to have a loss-of-function (partial or complete) or predicted loss-of-function (partial or complete). The GPR75 predicted loss-of-function polypeptide can be any of the GPR75 variant polypeptides described herein. In some embodiments, the methods detect the presence of GPR75 Ala110fs, Ala116Thr, Tyr207Cys, Gln234Stop, Arg236fs, or Cys400fs. In some embodiments, the methods detect the presence of Lys404*, Ser219fs, or c.-110+1G>A.

In some embodiments, the methods comprise performing an assay on a sample obtained from a subject to determine whether a GPR75 polypeptide in the sample comprises amino acids 110-130 according to SEQ ID NO:56. In some embodiments, the methods comprise performing an assay on a sample obtained from a subject to determine whether a GPR75 polypeptide in the sample comprises a threonine at a position corresponding to position 116 according to SEQ ID NO:57. In some embodiments, the methods comprise performing an assay on a sample obtained from a subject to determine whether a GPR75 polypeptide in the sample terminates at a position corresponding to position 233 according to SEQ ID NO:58. In some embodiments, the methods comprise performing an assay on a sample obtained from a subject to determine whether a GPR75 polypeptide in the sample comprises amino acids 236-239 according to SEQ ID NO:59. In some embodiments, the methods comprise performing an assay on a sample obtained from a subject to determine whether a GPR75 polypeptide in the sample comprises amino acids 400-425 according to SEQ ID NO:60. In some embodiments, the methods comprise performing an assay on a sample obtained from a subject to determine whether a GPR75 polypeptide in the sample comprises a cysteine at a position corresponding to position 207 according to SEQ ID NO:108.

In some embodiments, the detecting step comprises sequencing at least a portion of the polypeptide that comprises a position corresponding to any one or more of positions 110-130 according to SEQ ID NO:56 or SEQ ID NO:55. In some embodiments, the detecting step comprises sequencing at least a portion of the polypeptide that comprises a position corresponding to position 116 according to SEQ ID NO:57 or SEQ ID NO:55. In some embodiments, the detecting step comprises sequencing at least a portion of the polypeptide that comprises a position corresponding to any of positions 234-540 according to SEQ ID NO:55. In some embodiments, the detecting step comprises sequencing at least a portion of the polypeptide that comprises a position corresponding to any one or more of positions 236-239 according to SEQ ID NO:59 or SEQ ID NO:55. In some embodiments, the detecting step comprises sequencing at least a portion of the polypeptide that comprises a position corresponding to any one or more of positions 400-425 according to SEQ ID NO:60 or SEQ ID NO:55. In some embodiments, the detecting step comprises sequencing at least a portion of the polypeptide that comprises a position corresponding to position 207 according to SEQ ID NO:108.

In some embodiments, the detecting step comprises an immunoassay for detecting the presence of a polypeptide that comprises a position corresponding to any one or more of positions 110-130 according to SEQ ID NO:56 or SEQ ID NO:55. In some embodiments, the detecting step comprises an immunoassay for detecting the presence of a polypeptide that comprises a position corresponding to position 116 according to SEQ ID NO:57 or SEQ ID NO:55. In some embodiments, the detecting step comprises an immunoassay for detecting the presence of a polypeptide that comprises a position corresponding to any of positions 234-540 according to SEQ ID NO:55. In some embodiments, the detecting step comprises an immunoassay for detecting the presence of a polypeptide that comprises a position corresponding to any one or more of positions 236-239 according to SEQ ID NO:59 or SEQ ID NO:55. In some embodiments, the detecting step comprises an immunoassay for detecting the presence of a polypeptide that comprises a position corresponding to any one or more of positions 400-425 according to SEQ ID NO:60 or SEQ ID NO:55. In some embodiments, the detecting step comprises an immunoassay for detecting the presence of a polypeptide that comprises a position corresponding to position 207 according to SEQ ID NO:108 or SEQ ID NO:55.

In some embodiments, when the subject does not have a GPR75 predicted loss-of-function polypeptide, the subject has an increased risk for developing obesity or any of excessive weight, an elevated BMI, an elevated body fat mass, percentage, or volume, and/or excessive food intake. In some embodiments, when the subject has a GPR75 predicted loss-of-function polypeptide, the subject has a decreased risk for developing obesity or any of excessive weight, an elevated BMI, an elevated body fat mass, percentage, or volume, and/or excessive food intake.

The present disclosure also provides isolated nucleic acid molecules that hybridize to GPR75 variant genomic nucleic acid molecules, GPR75 variant mRNA molecules, and/or GPR75 variant cDNA molecules (such as any of the genomic variant nucleic acid molecules, mRNA variant molecules, and cDNA variant molecules disclosed herein). In some embodiments, the isolated nucleic acid molecules hybridize to a portion of the GPR75 nucleic acid molecule that includes a position corresponding to: positions 5,540-5,546 according to SEQ ID NO:2, positions 539-545 according to SEQ ID NO:11, positions 440-446 according to SEQ ID NO:16, positions 361-367 according to SEQ ID NO:21, positions 600-606 according to SEQ ID NO:26, positions 539-545 according to SEQ ID NO:35, positions 440-446 according to SEQ ID NO:40, positions 361-367 according to SEQ ID NO:45, or positions 600-606 according to SEQ ID NO:50.

In some embodiments, the isolated nucleic acid molecules hybridize to a portion of the GPR75 nucleic acid molecule that includes a position corresponding to: position 5,557 according to SEQ ID NO:3, position 556 according to SEQ ID NO:12, position 457 according to SEQ ID NO:17, position 378 according to SEQ ID NO:22, position 617 according to SEQ ID NO:27, position 556 according to SEQ ID NO:36, position 457 according to SEQ ID NO:41, position 378 according to SEQ ID NO:46, or position 617 according to SEQ ID NO:51.

In some embodiments, the isolated nucleic acid molecules hybridize to a portion of the GPR75 nucleic acid molecule that includes a position corresponding to: position 5,911 according to SEQ ID NO:4, position 910 according to SEQ ID NO:13, position 811 according to SEQ ID NO:18, position 732 according to SEQ ID NO:23, position 971 according to SEQ ID NO:28, position 910 according to SEQ ID NO:37, position 811 according to SEQ ID NO:42, position 732 according to SEQ ID NO:47, or position 971 according to SEQ ID NO:52.

In some embodiments, the isolated nucleic acid molecules hybridize to a portion of the GPR75 nucleic acid molecule that includes a position corresponding to: positions 5,920-5,923 according to SEQ ID NO:5, positions 919-922 according to SEQ ID NO:14, positions 820-823 according to SEQ ID NO:19, positions 741-744 according to SEQ ID NO:24, positions 980-983 according to SEQ ID NO:29, positions 919-922 according to SEQ ID NO:38, positions 820-823 according to SEQ ID NO:43, positions 741-744 according to SEQ ID NO:48, or positions 980-983 according to SEQ ID NO:53.

In some embodiments, the isolated nucleic acid molecules hybridize to a portion of the GPR75 nucleic acid molecule that includes a position corresponding to: position 6,411 according to SEQ ID NO:6, position 1,410 according to SEQ ID NO:15, position 1,311 according to SEQ ID NO:20, position 1,232 according to SEQ ID NO:25, position 1,471 according to SEQ ID NO:30, position 1,410 according to SEQ ID NO:39, position 1,311 according to SEQ ID NO:44, position 1,232 according to SEQ ID NO:49, or position 1,471 according to SEQ ID NO:54.

In some embodiments, the isolated nucleic acid molecules hybridize to a portion of the GPR75 nucleic acid molecule that includes a position corresponding to: position 5,831 according to SEQ ID NO:99, position 830 according to SEQ ID NO:100, position 731 according to SEQ ID NO:101, position 652 according to SEQ ID NO:102, position 891 according to SEQ ID NO:103, position 830 according to SEQ ID NO:104, position 731 according to SEQ ID NO:105, position 652 according to SEQ ID NO:106, or position 891 according to SEQ ID NO:107.

In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, at least about 100, at least about 200, at least about 300, at least about 400, at least about 500, at least about 600, at least about 700, at least about 800, at least about 900, at least about 1000, at least about 2000, at least about 3000, at least about 4000, or at least about 5000 nucleotides. In some embodiments, such isolated nucleic acid molecules comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, or at least about 25 nucleotides. In some embodiments, the isolated nucleic acid molecules comprise or consist of at least about 18 nucleotides. In some embodiments, the isolated nucleic acid molecules comprise or consists of at least about 15 nucleotides. In some embodiments, the isolated nucleic acid molecules consist of or comprise from about 10 to about 35, from about 10 to about 30, from about 10 to about 25, from about 12 to about 30, from about 12 to about 28, from about 12 to about 24, from about 15 to about 30, from about 15 to about 25, from about 18 to about 30, from about 18 to about 25, from about 18 to about 24, or from about 18 to about 22 nucleotides. In some embodiments, the isolated nucleic acid molecules consist of or comprise from about 18 to about 30 nucleotides. In some embodiments, the isolated nucleic acid molecules comprise or consist of at least about 15 nucleotides to at least about 35 nucleotides.

In some embodiments, such isolated nucleic acid molecules hybridize to GPR75 variant nucleic acid molecules (such as genomic nucleic acid molecules, mRNA molecules, and/or cDNA molecules) under stringent conditions. Such nucleic acid molecules can be used, for example, as probes, primers, alteration-specific probes, or alteration-specific primers as described or exemplified herein, and include, without limitation primers, probes, antisense RNAs, shRNAs, and siRNAs, each of which is described in more detail elsewhere herein, and can be used in any of the methods described herein.

In some embodiments, the isolated nucleic acid molecules hybridize to at least about 15 contiguous nucleotides of a nucleic acid molecule that is at least about 70%, at least about 75%, at least about 80%, at least about 85%, at least about 90%, at least about 95%, at least about 96%, at least about 97%, at least about 98%, at least about 99%, or 100% identical to GPR75 variant genomic nucleic acid molecules, GPR75 variant mRNA molecules, and/or GPR75 variant cDNA molecules. In some embodiments, the isolated nucleic acid molecules consist of or comprise from about 15 to about 100 nucleotides, or from about 15 to about 35 nucleotides. In some embodiments, the isolated nucleic acid molecules consist of or comprise from about 15 to about 100 nucleotides. In some embodiments, the isolated nucleic acid molecules consist of or comprise from about 15 to about 35 nucleotides.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human GPR75 polypeptide, wherein the portion comprises a position corresponding to: positions 5,540-5,546 according to SEQ ID NO:2, or the complement thereof; positions 539-545 according to SEQ ID NO:11, or the complement thereof; positions 440-446 according to SEQ ID NO:16, or the complement thereof; positions 361-367 according to SEQ ID NO:21, or the complement thereof; positions 600-606 according to SEQ ID NO:26, or the complement thereof; positions 539-545 according to SEQ ID NO:35, or the complement thereof; positions 440-446 according to SEQ ID NO:40, or the complement thereof; positions 361-367 according to SEQ ID NO:45, or the complement thereof; or positions 600-606 according to SEQ ID NO:50, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human GPR75 polypeptide, wherein the portion comprises a position corresponding to: position 5,557 according to SEQ ID NO:3, or the complement thereof; position 556 according to SEQ ID NO:12, or the complement thereof; position 457 according to SEQ ID NO:17, or the complement thereof; position 378 according to SEQ ID NO:22, or the complement thereof; position 617 according to SEQ ID NO:27, or the complement thereof; position 556 according to SEQ ID NO:36, or the complement thereof; position 457 according to SEQ ID NO:41, or the complement thereof; position 378 according to SEQ ID NO:46, or the complement thereof; or position 617 according to SEQ ID NO:51, or the complement thereof. In some embodiments, the alteration-specific probe or alteration-specific primer comprises a nucleotide sequence which is complementary to a portion of a nucleotide sequence comprising positions corresponding to: positions 5,557-5,559 according to SEQ ID NO:3, or the complement thereof; positions 556-558 according to SEQ ID NO:12, or the complement thereof; positions 457-459 according to SEQ ID NO:17, or the complement thereof; positions 378-380 according to SEQ ID NO:22, or the complement thereof; positions 617-619 according to SEQ ID NO:27, or the complement thereof; positions 556-558 according to SEQ ID NO:36, or the complement thereof; positions 457-459 according to SEQ ID NO:41, or the complement thereof; positions 378-380 according to SEQ ID NO:46, or the complement thereof; or positions 617-619 according to SEQ ID NO:51, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human GPR75 polypeptide, wherein the portion comprises a position corresponding to: position 5,911 according to SEQ ID NO:4, or the complement thereof; position 910 according to SEQ ID NO:13, or the complement thereof; position 811 according to SEQ ID NO:18, or the complement thereof; position 732 according to SEQ ID NO:23, or the complement thereof; position 971 according to SEQ ID NO:28, or the complement thereof; position 910 according to SEQ ID NO:37, or the complement thereof; position 811 according to SEQ ID NO:42, or the complement thereof; position 732 according to SEQ ID NO:47, or the complement thereof; or position 971 according to SEQ ID NO:52, or the complement thereof. In some embodiments, the alteration-specific probe or alteration-specific primer comprises a nucleotide sequence which is complementary to a portion of a nucleotide sequence comprising positions corresponding to: positions 5,911-5,913 according to SEQ ID NO:4, or the complement thereof; positions 910-912 according to SEQ ID NO:13, or the complement thereof; positions 811-813 according to SEQ ID NO:18, or the complement thereof; positions 732-734 according to SEQ ID NO:23, or the complement thereof; positions 971-973 according to SEQ ID NO:28, or the complement thereof; positions 910-912 according to SEQ ID NO:37, or the complement thereof; positions 811-813 according to SEQ ID NO:42, or the complement thereof; positions 732-734 according to SEQ ID NO:47, or the complement thereof; or positions 971-973 according to SEQ ID NO:52, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human GPR75 polypeptide, wherein the portion comprises a position corresponding to: positions 5,920-5,923 according to SEQ ID NO:5, or the complement thereof; positions 919-922 according to SEQ ID NO:14, or the complement thereof; positions 820-823 according to SEQ ID NO:19, or the complement thereof; positions 741-744 according to SEQ ID NO:24, or the complement thereof; positions 980-983 according to SEQ ID NO:29, or the complement thereof; positions 919-922 according to SEQ ID NO:38, or the complement thereof; positions 820-823 according to SEQ ID NO:43, or the complement thereof; positions 741-744 according to SEQ ID NO:48, or the complement thereof; or positions 980-983 according to SEQ ID NO:53, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human GPR75 polypeptide, wherein the portion comprises a position corresponding to: position 6,411 according to SEQ ID NO:6, or the complement thereof; position 1,410 according to SEQ ID NO:15, or the complement thereof; position 1,311 according to SEQ ID NO:20, or the complement thereof; position 1,232 according to SEQ ID NO:25, or the complement thereof; position 1,471 according to SEQ ID NO:30, or the complement thereof; position 1,410 according to SEQ ID NO:39, or the complement thereof; position 1,311 according to SEQ ID NO:44, or the complement thereof; position 1,232 according to SEQ ID NO:49, or the complement thereof; or position 1,471 according to SEQ ID NO:54, or the complement thereof.

In some embodiments, the isolated alteration-specific probes or alteration-specific primers comprise at least about 15 nucleotides, wherein the alteration-specific probe or alteration-specific primer comprises a nucleotide sequence which is complementary to a portion of a nucleotide sequence encoding a human GPR75 polypeptide, wherein the portion comprises a position corresponding to: position 5,831 according to SEQ ID NO:99, or the complement thereof; position 830 according to SEQ ID NO:100, or the complement thereof; position 731 according to SEQ ID NO:101, or the complement thereof; position 652 according to SEQ ID NO:102, or the complement thereof; position 891 according to SEQ ID NO:103, or the complement thereof; position 830 according to SEQ ID NO:104, or the complement thereof; position 731 according to SEQ ID NO:105, or the complement thereof; position 652 according to SEQ ID NO:106, or the complement thereof; or position 891 according to SEQ ID NO:107, or the complement thereof.

In some embodiments, the alteration-specific probes and alteration-specific primers comprise DNA. In some embodiments, the alteration-specific probes and alteration-specific primers comprise RNA.

In some embodiments, the probes and primers described herein (including alteration-specific probes and alteration-specific primers) have a nucleotide sequence that specifically hybridizes to any of the nucleic acid molecules disclosed herein, or the complement thereof. In some embodiments, the probes and primers specifically hybridize to any of the nucleic acid molecules disclosed herein under stringent conditions.

In some embodiments, the primers, including alteration-specific primers, can be used in second generation sequencing or high throughput sequencing. In some instances, the primers, including alteration-specific primers, can be modified. In particular, the primers can comprise various modifications that are used at different steps of, for example, Massive Parallel Signature Sequencing (MPSS), Polony sequencing, and 454 Pyrosequencing. Modified primers can be used at several steps of the process, including biotinylated primers in the cloning step and fluorescently labeled primers used at the bead loading step and detection step. Polony sequencing is generally performed using a paired-end tags library wherein each molecule of DNA template is about 135 bp in length. Biotinylated primers are used at the bead loading step and emulsion PCR. Fluorescently labeled degenerate nonamer oligonucleotides are used at the detection step. An adaptor can contain a 5'-biotin tag for immobilization of the DNA library onto streptavidin-coated beads.

The probes and primers described herein can be used to detect a nucleotide variation within any of the GPR75 variant genomic nucleic acid molecules, GPR75 variant mRNA molecules, and/or GPR75 variant cDNA molecules disclosed herein. The primers described herein can be used to amplify GPR75 variant genomic nucleic acid molecules, GPR75 variant mRNA molecules, or GPR75 variant cDNA molecules, or a fragment thereof.

In the context of the disclosure "specifically hybridizes" means that the probe or primer (such as, for example, the alteration-specific probe or alteration-specific primer) does not hybridize to a nucleic acid sequence encoding a GPR75 reference genomic nucleic acid molecule, a GPR75 reference mRNA molecule, and/or a GPR75 reference cDNA molecule.

In some embodiments, the probes (such as, for example, an alteration-specific probe) comprise a label. In some embodiments, the label is a fluorescent label, a radiolabel, or biotin.

The present disclosure also provides supports comprising a substrate to which any one or more of the probes disclosed herein is attached. Solid supports are solid-state substrates or supports with which molecules, such as any of the probes disclosed herein, can be associated. A form of solid support is an array. Another form of solid support is an array detector. An array detector is a solid support to which multiple different probes have been coupled in an array, grid, or other organized pattern. A form for a solid-state substrate is a microtiter dish, such as a standard 96-well type. In some embodiments, a multiwell glass slide can be employed that normally contains one array per well.

The present disclosure also provides molecular complexes comprising or consisting of any of the G-protein coupled receptor 75 nucleic acid molecules (genomic nucleic acid molecules, mRNA molecules, or cDNA molecules), or complement thereof, described herein and any of the alteration-specific primers or alteration-specific probes described herein. In some embodiments, the GPR75 nucleic acid molecules (genomic nucleic acid molecules, mRNA molecules, or cDNA molecules), or complement thereof, in the molecular complexes are single-stranded. In some embodiments, the GPR75 nucleic acid molecule is any of the genomic nucleic acid molecules described herein. In some embodiments, the GPR75 nucleic acid molecule is any of the mRNA molecules described herein. In some embodiments, the GPR75 nucleic acid molecule is any of the cDNA molecules described herein. In some embodiments, the molecular complex comprises or consists of any of the GPR75 nucleic acid molecules (genomic nucleic acid molecules, mRNA molecules, or cDNA molecules), or complement thereof, described herein and any of the alteration-specific primers described herein. In some embodiments, the molecular complex comprises or consists of any of the GPR75 nucleic acid molecules (genomic nucleic acid molecules, mRNA molecules, or cDNA molecules), or complement thereof, described herein and any of the alteration-specific probes described herein.

In some embodiments, the molecular complex comprises or consists of an alteration-specific primer or an alteration-specific probe hybridized to a genomic nucleic acid molecule comprising a nucleotide sequence encoding a human GPR75 polypeptide, wherein the alteration-specific primer or the alteration-specific probe is hybridized to the genomic nucleic acid molecule: at nucleotides at positions corresponding to positions 5,539-5,540 according to SEQ ID NO:2, or the complement thereof; at an adenine at a position corresponding to position 5,557 according to SEQ ID NO:3, or the complement thereof; at thymine at a position corresponding to position 5,911 according to SEQ ID NO:4, or the complement thereof; at nucleotides at positions corresponding to positions 5,919-5,920 according to SEQ ID NO:5, or the complement thereof; at a thymine at a position corresponding to position 6,411 according to SEQ ID NO:6, or the complement thereof; or at a guanine at a position corresponding to position 5,831 according to SEQ ID NO:99, or the complement thereof.

In some embodiments, the molecular complex comprises or consists of an alteration-specific primer or an alteration-specific probe that is hybridized to a genomic nucleic acid molecule at: an ACT codon at positions corresponding to positions 5,557-5,559 according to SEQ ID NO:3, a TAA codon at positions corresponding to positions 5,911-5,913 according to SEQ ID NO:4, or a TGT codon at positions corresponding to positions 5,830-5,832 according to SEQ ID NO:99.

In some embodiments, the molecular complex comprises or consists of an alteration-specific primer or an alteration-specific probe hybridized to a genomic nucleic acid molecule that comprises SEQ ID NO:2, SEQ ID NO:3, SEQ ID NO:4, SEQ ID NO:5, SEQ ID NO:6, or SEQ ID NO:99.

In some embodiments, the molecular complex comprises or consists of an alteration-specific primer or an alteration-specific probe hybridized to an mRNA molecule comprising a nucleotide sequence encoding a human GPR75 polypeptide, wherein the alteration-specific primer or the alteration-specific probe is hybridized to the mRNA molecule: at nucleotides at positions corresponding to positions 538-539 according to SEQ ID NO:11, or the complement thereof; at nucleotides at positions corresponding to positions 439-440 according to SEQ ID NO:16, or the complement thereof; at nucleotides at positions corresponding to positions 360-361 according to SEQ ID NO:21, or the complement thereof; at nucleotides at positions corresponding to positions 599-600 according to SEQ ID NO:26, or the complement thereof; at an adenine at a position corresponding to position 556 according to SEQ ID NO:12, or the complement thereof; at an adenine at a position corresponding to position 457 according to SEQ ID NO:17, or the complement thereof; at an adenine at a position corresponding to position 378 according to SEQ ID NO:22, or the complement thereof; at an adenine at a position corresponding to position 617 according to SEQ ID NO:27, or the complement thereof; at a uracil at a position corresponding to position 910 according to SEQ ID NO:13, or the complement thereof; at a uracil at a position corresponding to position 811 according to SEQ ID NO:18, or the complement thereof; at a uracil at a position corresponding to position 732 according to SEQ ID NO:23, or the complement thereof; at a uracil at a position corresponding to position 971 according to SEQ ID NO:28, or the complement thereof; at nucleotides at positions corresponding to positions 918-919 according to SEQ ID NO:14, or the complement thereof; at nucleotides at positions corresponding to positions 819-820 according to SEQ ID NO:19, or the complement thereof; at nucleotides at positions corresponding to positions 740-741 according to SEQ ID NO:24, or the complement thereof; at nucleotides at positions corresponding to positions 979-980 according to SEQ ID NO:29, or the complement thereof; at a uracil at a position corresponding to position 1,410 according to SEQ ID NO:15, or the complement thereof; at a uracil at a position corresponding to position 1,311 according to SEQ ID NO:20, or the complement thereof; at a uracil at a position corresponding to position 1,232 according to SEQ ID NO:25, the complement thereof; at of a uracil at a position corresponding to position 1,471 according to SEQ ID NO:30, or the complement thereof; at a guanine at a position corresponding to position 830 according to SEQ ID NO:100, or the complement thereof; at a guanine at a position corresponding to position 731 according to SEQ ID NO:101, or the complement thereof; at a guanine at a position corresponding to position 652 according to SEQ ID NO:102, or the complement thereof; or at a guanine at a position corresponding to position 891 according to SEQ ID NO:103, or the complement thereof.

In some embodiments, the molecular complex comprises or consists of an alteration-specific primer or an alteration-specific probe that is hybridized to an mRNA molecule at: an ACU codon at positions corresponding to positions 556-558 according to SEQ ID NO:12, an ACU codon at positions corresponding to positions 457-459 according to SEQ ID NO:17, an ACU codon at positions corresponding to positions 378-380 according to SEQ ID NO:22, an ACU codon at positions corresponding to positions 617-619 according to SEQ ID NO:27; a UAA codon at positions corresponding to positions 910-912 according to SEQ ID NO:13, a UAA codon at positions corresponding to positions 811-813 according to SEQ ID NO:18, a UAA codon at positions corresponding to positions 732-734 according to SEQ ID NO:23, a UAA codon at positions corresponding to positions 971-973 according to SEQ ID NO:28, a UGU codon at positions corresponding to positions 829-831 according to SEQ ID NO:100, a UGU codon at positions corresponding to positions 730-732 according to SEQ ID NO:101, a UGU codon at positions corresponding to positions 651-653 according to SEQ ID NO:102, or a UGU codon at positions corresponding to positions 890-892 according to SEQ ID NO:103.

In some embodiments, the molecular complex comprises or consists of an alteration-specific primer or an alteration-specific probe hybridized to an mRNA molecule that comprises SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:100, SEQ ID NO:101, SEQ ID NO:102, or SEQ ID NO:103.

In some embodiments, the molecular complex comprises or consists of an alteration-specific primer or an alteration-specific probe hybridized to a cDNA molecule comprising a nucleotide sequence encoding a human GPR75 polypeptide, wherein the alteration-specific primer or the alteration-specific probe is hybridized to a cDNA molecule: at nucleotides at positions corresponding to positions 538-539 according to SEQ ID NO:35, or the complement thereof; at nucleotides at positions corresponding to positions 439-440 according to SEQ ID NO:40, or the complement thereof; at nucleotides at positions corresponding to positions 360-361 according to SEQ ID NO:45, or the complement thereof; at nucleotides at positions corresponding to positions 599-600 according to SEQ ID NO:50, or the complement thereof; at an adenine at a position corresponding to position 556 according to SEQ ID NO:36, or the complement thereof; at an adenine at a position corresponding to position 457 according to SEQ ID NO:41, or the complement thereof; at an adenine at a position corresponding to position 378 according to SEQ ID NO:46, or the complement thereof; at an adenine at a position corresponding to position 617 according to SEQ ID NO:51, or the complement thereof; at a thymine at a position corresponding to position 910 according to SEQ ID NO:37, or the complement thereof; at a thymine at a position corresponding to position 811 according to SEQ ID NO:42, or the complement thereof; at a thymine at a position corresponding to position 732 according to SEQ ID NO:47, or the complement thereof; at a thymine at a position corresponding to position 971 according to SEQ ID NO:52, or the complement thereof; at nucleotides at positions corresponding to positions 918-919 according to SEQ ID NO:38, or the complement thereof; at nucleotides at positions corresponding to positions 819-820 according to SEQ ID NO:43, or the complement thereof; at nucleotides at positions corresponding to positions 740-741 according to SEQ ID NO:48, or the complement thereof; at nucleotides at positions corresponding to positions 979-980 according to SEQ ID NO:53, or the complement thereof; at a thymine at a position corresponding to position 1,410 according to SEQ ID NO:39, or the complement thereof; at a thymine at a position corresponding to position 1,311 according to SEQ ID NO:44, or the complement thereof; at a thymine at a position corresponding to position 1,232 according to SEQ ID NO:49, or the complement thereof; at a thymine at a position corresponding to position 1,471 according to SEQ ID NO:54, or the complement thereof; at a guanine at a position corresponding to position 830 according to SEQ ID NO:104, or the complement thereof; at a guanine at a position corresponding to position 731 according to SEQ ID NO:105, or the complement thereof; at a guanine at a position corresponding to position 652 according to SEQ ID NO:106, or the complement thereof; or at a guanine at a position corresponding to position 891 according to SEQ ID NO:107, or the complement thereof.

In some embodiments, the molecular complex comprises or consists of an alteration-specific primer or an alteration-specific probe that is hybridized to a cDNA molecule at: an ACT codon at positions corresponding to positions 556-558 according to SEQ ID NO:36, an ACT codon at positions corresponding to positions 457-459 according to SEQ ID NO:41, an ACT codon at positions corresponding to positions 378-380 according to SEQ ID NO:46, an ACT codon at positions corresponding to positions 617-619 according to SEQ ID NO:51; a TAA codon at positions corresponding to positions 910-912 according to SEQ ID NO:37, a TAA codon at positions corresponding to positions 811-813 according to SEQ ID NO:42, a TAA codon at positions corresponding to positions 732-734 according to SEQ ID NO:47, a TAA codon at positions corresponding to positions 971-973 according to SEQ ID NO:52, a TGT codon at positions corresponding to positions 829-831 according to SEQ ID NO:104, a TGT codon at positions corresponding to positions 730-732 according to SEQ ID NO:105, a TGT codon at positions corresponding to positions 651-653 according to SEQ ID NO:106, or a TGT codon at positions corresponding to positions 890-892 according to SEQ ID NO:107.

In some embodiments, the molecular complex comprises or consists of an alteration-specific primer or an alteration-specific probe hybridized to a cDNA molecule that comprises SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, or SEQ ID NO:54, SEQ ID NO:104, SEQ ID NO:105, SEQ ID NO:106, or SEQ ID NO:107.

In some embodiments, the molecular complex comprises an alteration-specific probe or an alteration-specific primer comprising a label. In some embodiments, the label is a fluorescent label, a radiolabel, or biotin. In some embodiments, the molecular complex further comprises a non-human polymerase.

The present disclosure also provides isolated nucleic acid molecules comprising a nucleotide sequence encoding a human GPR75 variant polypeptide. In some embodiments, the GPR75 variant polypeptide comprises a frameshift beginning at a position corresponding to position 110 according to SEQ ID NO:56, or the complement thereof. In some embodiments, the isolated nucleic acid molecule encodes a GPR75 variant polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:56, and comprises a frameshift beginning at a position corresponding to position 110 according to SEQ ID NO:56. In some embodiments, the isolated nucleic acid molecule encodes a GPR75 variant polypeptide having an amino acid sequence that has at least about 90% sequence identity to SEQ ID NO:56, and comprises a frameshift beginning at a position corresponding to position 110 according to SEQ ID NO:56. In some embodiments, the isolated nucleic acid molecule encodes a GPR75 variant polypeptide having an amino acid sequence that has at least about 92% sequence identity to SEQ ID NO:56, and comprises a frameshift beginning at a position corresponding to position 110 according to SEQ ID NO:56. In some embodiments, the isolated nucleic acid molecule encodes a GPR75 variant polypeptide having an amino acid sequence that has at least about 94% sequence identity to SEQ ID NO:56, and comprises a frameshift beginning at a position corresponding to position 110 according to SEQ ID NO:56. In some embodiments, the isolated nucleic acid molecule encodes a GPR75 variant polypeptide having an amino acid sequence that has at least about 96% sequence identity to SEQ ID NO:56, and comprises a frameshift beginning at a position corresponding to position 110 according to SEQ ID NO:56. In some embodiments, the isolated nucleic acid molecule encodes a GPR75 variant polypeptide having an amino acid sequence that has at least about 98% sequence identity to SEQ ID NO:56, and comprises a frameshift beginning at a position corresponding to position 110 according to SEQ ID NO:56. In some embodiments, the nucleic acid molecule encodes a GPR75 variant polypeptide comprising SEQ ID NO:56. In some embodiments, the nucleic acid molecule encodes a GPR75 variant polypeptide consisting of SEQ ID NO:56. Each of these nucleic acid molecules encodes a GPR75 polypeptide that lacks amino acids at positions corresponding to positions 110-540 according to SEQ ID NO:55. In some embodiments, each of these nucleic acid molecules encodes a GPR75 polypeptide that comprises amino acids at positions corresponding to positions 110-130 according to SEQ ID NO:56.

In some embodiments, the GPR75 variant polypeptide comprises a threonine at a position corresponding to position 116 according to SEQ ID NO:57, or the complement thereof. In some embodiments, the isolated nucleic acid molecule encodes a GPR75 variant polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:57, and comprises a threonine at a position corresponding to position 116 according to SEQ ID NO:57. In some embodiments, the isolated nucleic acid molecule encodes a GPR75 variant polypeptide having an amino acid sequence that has at least about 90% sequence identity to SEQ ID NO:57, and comprises a threonine at a position corresponding to position 116 according to SEQ ID NO:57. In some embodiments, the isolated nucleic acid molecule encodes a GPR75 variant polypeptide having an amino acid sequence that has at least about 92% sequence identity to SEQ ID NO:57, and comprises a threonine at a position corresponding to position 116 according to SEQ ID NO:57. In some embodiments, the isolated nucleic acid molecule encodes a GPR75 variant polypeptide having an amino acid sequence that has at least about 94% sequence identity to SEQ ID NO:57, and comprises a threonine at a position corresponding to position 116 according to SEQ ID NO:57. In some embodiments, the isolated nucleic acid molecule encodes a GPR75 variant polypeptide having an amino acid sequence that has at least about 96% sequence identity to SEQ ID NO:57, and comprises a threonine at a position corresponding to position 116 according to SEQ ID NO:57. In some embodiments, the isolated nucleic acid molecule encodes a GPR75 variant polypeptide having an amino acid sequence that has at least about 98% sequence identity to SEQ ID NO:57, and comprises a threonine at a position corresponding to position 116 according to SEQ ID NO:57. In some embodiments, the nucleic acid molecule encodes a GPR75 variant polypeptide comprising SEQ ID NO:57. In some embodiments, the nucleic acid molecule encodes a GPR75 variant polypeptide consisting of SEQ ID NO:57.

In some embodiments, the GPR75 variant polypeptide terminates at a position corresponding to position 233 according to SEQ ID NO:58, or the complement thereof. In some embodiments, the isolated nucleic acid molecule encodes a GPR75 variant polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:58, and terminates at a position corresponding to position 233 according to SEQ ID NO:58. In some embodiments, the isolated nucleic acid molecule encodes a GPR75 variant polypeptide having an amino acid sequence that has at least about 90% sequence identity to SEQ ID NO:58, and terminates at a position corresponding to position 233 according to SEQ ID NO:58. In some embodiments, the isolated nucleic acid molecule encodes a GPR75 variant polypeptide having an amino acid sequence that has at least about 92% sequence identity to SEQ ID NO:58, and terminates at a position corresponding to position 233 according to SEQ ID NO:58. In some embodiments, the isolated nucleic acid molecule encodes a GPR75 variant polypeptide having an amino acid sequence that has at least about 94% sequence identity to SEQ ID NO:58, and terminates at a position corresponding to position 233 according to SEQ ID NO:58. In some embodiments, the isolated nucleic acid molecule encodes a GPR75 variant polypeptide having an amino acid sequence that has at least about 96% sequence identity to SEQ ID NO:58, and terminates at a position corresponding to position 233 according to SEQ ID NO:58. In some embodiments, the isolated nucleic acid molecule encodes a GPR75 variant polypeptide having an amino acid sequence that has at least about 98% sequence identity to SEQ ID NO:58, and terminates at a position corresponding to position 233 according to SEQ ID NO:58. In some embodiments, the nucleic acid molecule encodes a GPR75 variant polypeptide comprising SEQ ID NO:58. In some embodiments, the nucleic acid molecule encodes a GPR75 variant polypeptide consisting of SEQ ID NO:58.

In some embodiments, the GPR75 variant polypeptide comprises a frameshift beginning at a position corresponding to position 236 according to SEQ ID NO:59, or the complement thereof. In some embodiments, the isolated nucleic acid molecule encodes a GPR75 variant polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:59, and comprises a frameshift beginning at a position corresponding to position 236 according to SEQ ID NO:59. In some embodiments, the isolated nucleic acid molecule encodes a GPR75 variant polypeptide having an amino acid sequence that has at least about 90% sequence identity to SEQ ID NO:59, and comprises a frameshift beginning at a position corresponding to position 236 according to SEQ ID NO:59. In some embodiments, the isolated nucleic acid molecule encodes a GPR75 variant polypeptide having an amino acid sequence that has at least about 92% sequence identity to SEQ ID NO:59, and comprises a frameshift beginning at a position corresponding to position 236 according to SEQ ID NO:59. In some embodiments, the isolated nucleic acid molecule encodes a GPR75 variant polypeptide having an amino acid sequence that has at least about 94% sequence identity to SEQ ID NO:59, and comprises a frameshift beginning at a position corresponding to position 236 according to SEQ ID NO:59. In some embodiments, the isolated nucleic acid molecule encodes a GPR75 variant polypeptide having an amino acid sequence that has at least about 96% sequence identity to SEQ ID NO:59, and comprises a frameshift beginning at a position corresponding to position 236 according to SEQ ID NO:59. In some embodiments, the isolated nucleic acid molecule encodes a GPR75 variant polypeptide having an amino acid sequence that has at least about 98% sequence identity to SEQ ID NO:59, and comprises a frameshift beginning at a position corresponding to position 236 according to SEQ ID NO:59. In some embodiments, the nucleic acid molecule encodes a GPR75 variant polypeptide comprising SEQ ID NO:59. In some embodiments, the nucleic acid molecule encodes a GPR75 variant polypeptide consisting of SEQ ID NO:59. Each of these nucleic acid molecules encodes a GPR75 polypeptide that lacks amino acids at positions corresponding to positions 236-540 according to SEQ ID NO:55. In some embodiments, each of these nucleic acid molecules encodes a GPR75 polypeptide that comprises amino acids at positions corresponding to positions 236-239 according to SEQ ID NO:59.

In some embodiments, the GPR75 variant polypeptide comprises a frameshift beginning at a position corresponding to position 400 according to SEQ ID NO:60, or the complement thereof. In some embodiments, the isolated nucleic acid molecule encodes a GPR75 variant polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:60, and comprises a frameshift beginning at a position corresponding to position 400 according to SEQ ID NO:60. In some embodiments, the isolated nucleic acid molecule encodes a GPR75 variant polypeptide having an amino acid sequence that has at least about 90% sequence identity to SEQ ID NO:60, and comprises a frameshift beginning at a position corresponding to position 400 according to SEQ ID NO:60. In some embodiments, the isolated nucleic acid molecule encodes a GPR75 variant polypeptide having an amino acid sequence that has at least about 92% sequence identity to SEQ ID NO:60, and comprises a frameshift beginning at a position corresponding to position 400 according to SEQ ID NO:60. In some embodiments, the isolated nucleic acid molecule encodes a GPR75 variant polypeptide having an amino acid sequence that has at least about 94% sequence identity to SEQ ID NO:60, and comprises a frameshift beginning at a position corresponding to position 400 according to SEQ ID NO:60. In some embodiments, the isolated nucleic acid molecule encodes a GPR75 variant polypeptide having an amino acid sequence that has at least about 96% sequence identity to SEQ ID NO:60, and comprises a frameshift beginning at a position corresponding to position 400 according to SEQ ID NO:60. In some embodiments, the isolated nucleic acid molecule encodes a GPR75 variant polypeptide having an amino acid sequence that has at least about 98% sequence identity to SEQ ID NO:60, and comprises a frameshift beginning at a position corresponding to position 400 according to SEQ ID NO:60. In some embodiments, the nucleic acid molecule encodes a GPR75 variant polypeptide comprising SEQ ID NO:60. In some embodiments, the nucleic acid molecule encodes a GPR75 variant polypeptide consisting of SEQ ID NO:60. Each of these nucleic acid molecules encodes a GPR75 polypeptide that lacks amino acids at positions corresponding to positions 400-540 according to SEQ ID NO:55. In some embodiments, each of these nucleic acid molecules encodes a GPR75 polypeptide that comprises amino acids at positions corresponding to positions 400-425 according to SEQ ID NO:60.

In some embodiments, the GPR75 variant polypeptide comprises a cysteine at a position corresponding to position 207 according to SEQ ID NO:108, or the complement thereof. In some embodiments, the isolated nucleic acid molecule encodes a GPR75 variant polypeptide having an amino acid sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:108, and comprises a cysteine at a position corresponding to position 207 according to SEQ ID NO:108. In some embodiments, the isolated nucleic acid molecule encodes a GPR75 variant polypeptide having an amino acid sequence that has at least about 90% sequence identity to SEQ ID NO:108, and comprises a cysteine at a position corresponding to position 207 according to SEQ ID NO:108. In some embodiments, the isolated nucleic acid molecule encodes a GPR75 variant polypeptide having an amino acid sequence that has at least about 92% sequence identity to SEQ ID NO:108, and comprises a cysteine at a position corresponding to position 207 according to SEQ ID NO:108. In some embodiments, the isolated nucleic acid molecule encodes a GPR75 variant polypeptide having an amino acid sequence that has at least about 94% sequence identity to SEQ ID NO:108, and comprises a cysteine at a position corresponding to position 207 according to SEQ ID NO:108. In some embodiments, the isolated nucleic acid molecule encodes a GPR75 variant polypeptide having an amino acid sequence that has at least about 96% sequence identity to SEQ ID NO:108, and comprises a cysteine at a position corresponding to position 207 according to SEQ ID NO:108. In some embodiments, the isolated nucleic acid molecule encodes a GPR75 variant polypeptide having an amino acid sequence that has at least about 98% sequence identity to SEQ ID NO:108, and comprises a cysteine at a position corresponding to position 207 according to SEQ ID NO:108. In some embodiments, the nucleic acid molecule encodes a GPR75 variant polypeptide comprising SEQ ID NO:108. In some embodiments, the nucleic acid molecule encodes a GPR75 variant polypeptide consisting of SEQ ID NO:108.

The nucleotide sequence of a GPR75 reference genomic nucleic acid molecule is set forth in SEQ ID NO:1. See, also, ENSG00000119737.6, hg38 chr2:53,852,912-53,859,967. Referring to SEQ ID NO:1, positions 5,540-5,546 are a CCAGTAG heptanucleotide. Referring to SEQ ID NO:1, position 5,557 is a guanine. Referring to SEQ ID NO:1, position 5,911 is a cytosine. Referring to SEQ ID NO:1, positions 5,920-5,923 are an AAAG tetranucleotide. Referring to SEQ ID NO:1, position 6,411 is a cytosine. Referring to SEQ ID NO:1, position 5,831 is an adenine.

A variant genomic nucleic acid molecule of GPR75 exists, wherein the CCAGTAG heptanucleotide at positions 5,540-5,546 (referring to SEQ ID NO:1) is deleted. The nucleotide sequence of this GPR75 variant genomic nucleic acid molecule is set forth in SEQ ID NO:2.

Another variant genomic nucleic acid molecule of GPR75 exists, wherein the guanine at position 5,557 (referring to SEQ ID NO:1) is replaced with adenine. The nucleotide sequence of this GPR75 variant genomic nucleic acid molecule is set forth in SEQ ID NO:3.

Another variant genomic nucleic acid molecule of GPR75 exists, wherein the cytosine at position 5,911 (referring to SEQ ID NO:1) is replaced with thymine. The nucleotide sequence of this GPR75 variant genomic nucleic acid molecule is set forth in SEQ ID NO:4.

Another variant genomic nucleic acid molecule of GPR75 exists, wherein the AAAG tetranucleotide at positions 5,920-5,923 (referring to SEQ ID NO:1) is deleted. The nucleotide sequence of this GPR75 variant genomic nucleic acid molecule is set forth in SEQ ID NO:5.

Another variant genomic nucleic acid molecule of GPR75 exists, a thymine is inserted at position 6,411 (referring to SEQ ID NO:1). The nucleotide sequence of this GPR75 variant genomic nucleic acid molecule is set forth in SEQ ID NO:6.

Another variant genomic nucleic acid molecule of GPR75 exists, wherein the adenine at position 5,831 (referring to SEQ ID NO:1) is replaced with guanine. The nucleotide sequence of this GPR75 variant genomic nucleic acid molecule is set forth in SEQ ID NO:99.

Another variant genomic nucleic acid molecule of GPR75 exists, wherein the thymine at position 53,853,547 on chromosome 2 (according to GRCh38/hg38 (December 2013) human genome assembly) is replaced with adenine, resulting in Lys404*. Referring to SEQ ID NO:1, the variation is AAG to TAG (at the codon at positions 6,421-6,423 on the coding strand). Each of the methods described herein in regard to any of the variants described herein can be carried out with this additional variant (i.e., genomic, mRNA, and cDNA molecules) as well.

Another variant genomic nucleic acid molecule of GPR75 exists, wherein the CAG beginning at position 53,854,099 on chromosome 2 (according to GRCh38/hg38 (December 2013) human genome assembly) is replaced with cytosine, resulting in Ser219fs. Referring to SEQ ID NO:1, the variation is GTC (at positions 5,869-5,871 on the coding strand) to G. Each of the methods described herein in regard to any of the variants described herein can be carried out with this additional variant (i.e., genomic, mRNA, and cDNA molecules) as well.

Another variant genomic nucleic acid molecule of GPR75 exists, wherein the cytosine at position 53,859,827 on chromosome 2 (according to GRCh38/hg38 (December 2013) human genome assembly) is replaced with thymine (with a cDNA designated c.-110+1G>A), which is a splice donor site variation 110 bases upstream of the start codon. Referring to SEQ ID NO:1, the variation is G (at position 141 on the coding strand) to A. Each of the methods described herein in regard to any of the variants described herein can be carried out with this additional variant (i.e., genomic, mRNA, and cDNA molecules) as well.

The present disclosure also provides isolated genomic nucleic acid molecules comprising or consisting of a nucleotide sequence encoding a human GPR75 polypeptide. In some embodiments, the nucleotide sequence of the genomic nucleic acid molecule lacks a CCAGTAG heptanucleotide at positions corresponding to positions 5,540-5,546 according to SEQ ID NO:1, or the complement thereof. An example is set forth in SEQ ID NO:2.

In some embodiments, the nucleotide sequence of the genomic nucleic acid molecule lacks an AAAG tetranucleotide at positions corresponding to positions 5,920-5,923 according to SEQ ID NO:1, or the complement thereof. An example is set forth in SEQ ID NO:5.

In some embodiments, the nucleotide sequence of the genomic nucleic acid molecule comprises an insertion of a thymine at a position corresponding to position 6,411 according to SEQ ID NO:1, or the complement thereof. An example is set forth in SEQ ID NO:6.

In some embodiments, the isolated genomic nucleic acid molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:2, and lacks a CCAGTAG heptanucleotide at positions corresponding to positions 5,540-5,546 according to SEQ ID NO:1, or the complement thereof. In some embodiments, the isolated genomic nucleic acid molecules comprise or consist of a nucleotide sequence that has at least about 90% sequence identity to SEQ ID NO:2, and lacks a CCAGTAG heptanucleotide at positions corresponding to positions 5,540-5,546 according to SEQ ID NO:1, or the complement thereof. In some embodiments, the isolated genomic nucleic acid molecules comprise or consist of a nucleotide sequence that has at least about 92% sequence identity to SEQ ID NO:2, and lacks a CCAGTAG heptanucleotide at positions corresponding to positions 5,540-5,546 according to SEQ ID NO:1, or the complement thereof. In some embodiments, the isolated genomic nucleic acid molecules comprise or consist of a nucleotide sequence that has at least about 94% sequence identity to SEQ ID NO:2, and lacks a CCAGTAG heptanucleotide at positions corresponding to positions 5,540-5,546 according to SEQ ID NO:1, or the complement thereof. In some embodiments, the isolated genomic nucleic acid molecules comprise or consist of a nucleotide sequence that has at least about 96% sequence identity to SEQ ID NO:2, and lacks a CCAGTAG heptanucleotide at positions corresponding to positions 5,540-5,546 according to SEQ ID NO:1, or the complement thereof. In some embodiments, the isolated genomic nucleic acid molecules comprise or consist of a nucleotide sequence that has at least about 98% sequence identity to SEQ ID NO:2, and lacks a CCAGTAG heptanucleotide at positions corresponding to positions 5,540-5,546 according to SEQ ID NO:1, or the complement thereof.

In some embodiments, the isolated genomic nucleic acid molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:5, and lacks an AAAG tetranucleotide at positions corresponding to positions 5,920-5,923 according to SEQ ID NO:1, or the complement thereof. In some embodiments, the isolated genomic nucleic acid molecules comprise or consist of a nucleotide sequence that has at least about 90% sequence identity to SEQ ID NO:5, and lacks an AAAG tetranucleotide at positions corresponding to positions 5,920-5,923 according to SEQ ID NO:1, or the complement thereof. In some embodiments, the isolated genomic nucleic acid molecules comprise or consist of a nucleotide sequence that has at least about 92% sequence identity to SEQ ID NO:5, and lacks an AAAG tetranucleotide at positions corresponding to positions 5,920-5,923 according to SEQ ID NO:1, or the complement thereof. In some embodiments, the isolated genomic nucleic acid molecules comprise or consist of a nucleotide sequence that has at least about 94% sequence identity to SEQ ID NO:5, and lacks an AAAG tetranucleotide at positions corresponding to positions 5,920-5,923 according to SEQ ID NO:1, or the complement thereof. In some embodiments, the isolated genomic nucleic acid molecules comprise or consist of a nucleotide sequence that has at least about 96% sequence identity to SEQ ID NO:5, and lacks an AAAG tetranucleotide at positions corresponding to positions 5,920-5,923 according to SEQ ID NO:1, or the complement thereof. In some embodiments, the isolated genomic nucleic acid molecules comprise or consist of a nucleotide sequence that has at least about 98% sequence identity to SEQ ID NO:5, and lacks an AAAG tetranucleotide at positions corresponding to positions 5,920-5,923 according to SEQ ID NO:1, or the complement thereof.

In some embodiments, the isolated genomic nucleic acid molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:6, and comprises an insertion of a thymine at a position corresponding to position 6,411 according to SEQ ID NO:6, or the complement thereof. In some embodiments, the isolated genomic nucleic acid molecules comprise or consist of a nucleotide sequence that has at least about 90% sequence identity to SEQ ID NO:6, and comprises an insertion of a thymine at a position corresponding to position 6,411 according to SEQ ID NO:6, or the complement thereof. In some embodiments, the isolated genomic nucleic acid molecules comprise or consist of a nucleotide sequence that has at least about 92% sequence identity to SEQ ID NO:6, and comprises an insertion of a thymine at a position corresponding to position 6,411 according to SEQ ID NO:6, or the complement thereof. In some embodiments, the isolated genomic nucleic acid molecules comprise or consist of a nucleotide sequence that has at least about 94% sequence identity to SEQ ID NO:6, and comprises an insertion of a thymine at a position corresponding to position 6,411 according to SEQ ID NO:6, or the complement thereof. In some embodiments, the isolated genomic nucleic acid molecules comprise or consist of a nucleotide sequence that has at least about 96% sequence identity to SEQ ID NO:6, and comprises an insertion of a thymine at a position corresponding to position 6,411 according to SEQ ID NO:6, or the complement thereof. In some embodiments, the isolated genomic nucleic acid molecules comprise or consist of a nucleotide sequence that has at least about 98% sequence identity to SEQ ID NO:6, and comprises an insertion of a thymine at a position corresponding to position 6,411 according to SEQ ID NO:6, or the complement thereof.

In some embodiments, the isolated genomic nucleic acid molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:99, and comprises a guanine at a position corresponding to position 5,831 according to SEQ ID NO:99, or the complement thereof. In some embodiments, the isolated genomic nucleic acid molecules comprise or consist of a nucleotide sequence that has at least about 90% sequence identity to SEQ ID NO:99, and comprises a guanine at a position corresponding to position 5,831 according to SEQ ID NO:99, or the complement thereof. In some embodiments, the isolated genomic nucleic acid molecules comprise or consist of a nucleotide sequence that has at least about 92% sequence identity to SEQ ID NO:99, and comprises a guanine at a position corresponding to position 5,831 according to SEQ ID NO:99, or the complement thereof. In some embodiments, the isolated genomic nucleic acid molecules comprise or consist of a nucleotide sequence that has at least about 94% sequence identity to SEQ ID NO:99, and comprises a guanine at a position corresponding to position 5,831 according to SEQ ID NO:99, or the complement thereof. In some embodiments, the isolated genomic nucleic acid molecules comprise or consist of a nucleotide sequence that has at least about 96% sequence identity to SEQ ID NO:99, and comprises a guanine at a position corresponding to position 5,831 according to SEQ ID NO:99, or the complement thereof. In some embodiments, the isolated genomic nucleic acid molecules comprise or consist of a nucleotide sequence that has at least about 98% sequence identity to SEQ ID NO:99, and comprises a guanine at a position corresponding to position 5,831 according to SEQ ID NO:99, or the complement thereof.

Herein, if reference is made to percent sequence identity, the higher percentages of sequence identity are preferred over the lower ones.

In some embodiments, the isolated genomic nucleic acid molecules comprise SEQ ID NO:2. In some embodiments, the isolated genomic nucleic acid molecules consist of SEQ ID NO:2. In some embodiments, the isolated genomic nucleic acid molecules comprise SEQ ID NO:3. In some embodiments, the isolated genomic nucleic acid molecules consist of SEQ ID NO:3. In some embodiments, the isolated genomic nucleic acid molecules comprise SEQ ID NO:4. In some embodiments, the isolated genomic nucleic acid molecules consist of SEQ ID NO:4. In some embodiments, the isolated genomic nucleic acid molecules comprise SEQ ID NO:5. In some embodiments, the isolated genomic nucleic acid molecules consist of SEQ ID NO:5. In some embodiments, the isolated genomic nucleic acid molecules comprise SEQ ID NO:6. In some embodiments, the isolated genomic nucleic acid molecules consist of SEQ ID NO:6. In some embodiments, the isolated genomic nucleic acid molecules comprise SEQ ID NO:99. In some embodiments, the isolated genomic nucleic acid molecules consist of SEQ ID NO:99.

In some embodiments, the isolated genomic nucleic acid molecules comprise less than the entire genomic DNA sequence. In some embodiments, the isolated genomic nucleic acid molecules comprise or consist of at least about 15, at least about 20, at least about 25, at least about 30, at least about 35, at least about 40, at least about 45, at least about 50, at least about 60, at least about 70, at least about 80, at least about 90, at least about 100, at least about 200, at least about 300, at least about 400, at least about 500, at least about 600, at least about 700, at least about 800, at least about 900, at least about 1000, at least about 2000, at least about 3000, at least about 4000, at least about 5000, at least about 6000, at least about 7000, at least about 8000, at least about 9000, or at least about 10000 contiguous nucleotides of any of the GPR75 genomic nucleic acid molecules disclosed herein. In some embodiments, the isolated genomic nucleic acid molecules comprise or consist of at least about 1000 to at least about 2000 contiguous nucleotides of any of the GPR75 genomic nucleic acid molecules disclosed herein. In some embodiments, these isolated genomic nucleic acid molecules lack a CCAGTAG heptanucleotide at positions corresponding to positions 5,540-5,546 according to SEQ ID NO:1. In some embodiments, these isolated genomic nucleic acid molecules lack an AAAG tetranucleotide at positions corresponding to positions 5,920-5,923 according to SEQ ID NO:1. In some embodiments, these isolated genomic nucleic acid molecules comprise the insertion of thymine at a position corresponding to position 6,411 according to SEQ ID NO:6.

The nucleotide sequence of a GPR75 reference mRNA molecule is set forth in SEQ ID NO:7. Referring to SEQ ID NO:7, positions 539-545 are a CCAGUAG heptanucleotide. Referring to SEQ ID NO:7, position 566 is a guanine. Referring to SEQ ID NO:7, position 910 is a cytosine. Referring to SEQ ID NO:7, positions 919-922 are an AAAG tetranucleotide. Referring to SEQ ID NO:7, position 1,410 is a cytosine. Referring to SEQ ID NO:7, position 830 is an adenine.

The nucleotide sequence of another GPR75 reference mRNA molecule is set forth in SEQ ID NO:8. Referring to SEQ ID NO:8, positions 440-446 are a CCAGUAG heptanucleotide. Referring to SEQ ID NO:8, position 457 is a guanine. Referring to SEQ ID NO:8, position 811 is a cytosine. Referring to SEQ ID NO:8, positions 820-823 are an AAAG tetranucleotide. Referring to SEQ ID NO:8, position 1,311 is a cytosine. Referring to SEQ ID NO:8, position 731 is an adenine.

The nucleotide sequence of another GPR75 reference mRNA molecule is set forth in SEQ ID NO:9. Referring to SEQ ID NO:9, positions 361-367 are a CCAGUAG heptanucleotide. Referring to SEQ ID NO:9, position 378 is a guanine. Referring to SEQ ID NO:9, position 732 is a cytosine. Referring to SEQ ID NO:9, positions 741-744 are an AAAG tetranucleotide. Referring to SEQ ID NO:9, position 1,232 is a cytosine. Referring to SEQ ID NO:9, position 652 is an adenine.

The nucleotide sequence of another GPR75 reference mRNA molecule is set forth in SEQ ID NO:10. Referring to SEQ ID NO:10, positions 600-606 are a CCAGUAG heptanucleotide. Referring to SEQ ID NO:10, position 617 is a guanine. Referring to SEQ ID NO:10, position 971 is a cytosine. Referring to SEQ ID NO:10, positions 980-983 are an AAAG tetranucleotide. Referring to SEQ ID NO:10, position 1,471 is a cytosine. Referring to SEQ ID NO:10, position 891 is an adenine.

A variant mRNA molecule of GPR75 exists, wherein the CCAGUAG heptanucleotide at positions 539-545 (referring to SEQ ID NO:7) is deleted. The nucleotide sequence of this GPR75 variant mRNA molecule is set forth in SEQ ID NO:11.

Another variant mRNA molecule of GPR75 exists, wherein the CCAGUAG heptanucleotide at positions 440-446 (referring to SEQ ID NO:8) is deleted. The nucleotide sequence of this GPR75 variant mRNA molecule is set forth in SEQ ID NO:16.

Another variant mRNA molecule of GPR75 exists, wherein the CCAGUAG heptanucleotide at positions 361-367 (referring to SEQ ID NO:9) is deleted. The nucleotide sequence of this GPR75 variant mRNA molecule is set forth in SEQ ID NO:21.

Another variant mRNA molecule of GPR75 exists, wherein the CCAGUAG heptanucleotide at positions 600-606 (referring to SEQ ID NO:10) is deleted. The nucleotide sequence of this GPR75 variant mRNA molecule is set forth in SEQ ID NO:26.

A variant mRNA molecule of GPR75 exists, wherein the guanine at position 556 (referring to SEQ ID NO:7) is replaced with adenine. The nucleotide sequence of this GPR75 variant mRNA molecule is set forth in SEQ ID NO:12.

Another variant mRNA molecule of GPR75 exists, wherein the guanine at position 457 (referring to SEQ ID NO:8) is replaced with adenine. The nucleotide sequence of this GPR75 variant mRNA molecule is set forth in SEQ ID NO:17.

Another variant mRNA molecule of GPR75 exists, wherein the guanine at position 378 (referring to SEQ ID NO:9) is replaced with adenine. The nucleotide sequence of this GPR75 variant mRNA molecule is set forth in SEQ ID NO:22.

Another variant mRNA molecule of GPR75 exists, wherein the guanine at position 617 (referring to SEQ ID NO:10) is replaced with adenine. The nucleotide sequence of this GPR75 variant mRNA molecule is set forth in SEQ ID NO:27.

A variant mRNA molecule of GPR75 exists, wherein the cytosine at position 910 (referring to SEQ ID NO:7) is replaced with uracil. The nucleotide sequence of this GPR75 variant mRNA molecule is set forth in SEQ ID NO:13.

Another variant mRNA molecule of GPR75 exists, wherein the cytosine at position 811 (referring to SEQ ID NO:8) is replaced with uracil. The nucleotide sequence of this GPR75 variant mRNA molecule is set forth in SEQ ID NO:18.

Another variant mRNA molecule of GPR75 exists, wherein the cytosine at position 732 (referring to SEQ ID NO:9) is replaced with uracil. The nucleotide sequence of this GPR75 variant mRNA molecule is set forth in SEQ ID NO:23.

Another variant mRNA molecule of GPR75 exists, wherein the cytosine at position 971 (referring to SEQ ID NO:10) is replaced with uracil. The nucleotide sequence of this GPR75 variant mRNA molecule is set forth in SEQ ID NO:28.

A variant mRNA molecule of GPR75 exists, wherein the AAAG tetranucleotide at positions 919-922 (referring to SEQ ID NO:7) is deleted. The nucleotide sequence of this GPR75 variant mRNA molecule is set forth in SEQ ID NO:14.

Another variant mRNA molecule of GPR75 exists, wherein the AAAG tetranucleotide at positions 820-823 (referring to SEQ ID NO:8) is deleted. The nucleotide sequence of this GPR75 variant mRNA molecule is set forth in SEQ ID NO:19.

Another variant mRNA molecule of GPR75 exists, wherein the AAAG tetranucleotide at positions 741-744 (referring to SEQ ID NO:9) is deleted. The nucleotide sequence of this GPR75 variant mRNA molecule is set forth in SEQ ID NO:24.

Another variant mRNA molecule of GPR75 exists, wherein AAAG tetranucleotide at positions 980-983 (referring to SEQ ID NO:10) is replaced with deleted. The nucleotide sequence of this GPR75 variant mRNA molecule is set forth in SEQ ID NO:29.

A variant mRNA molecule of GPR75 exists, wherein a uracil is inserted at position 1,410 (referring to SEQ ID NO:7). The nucleotide sequence of this GPR75 variant mRNA molecule is set forth in SEQ ID NO:15.

Another variant mRNA molecule of GPR75 exists, wherein a uracil is inserted at position 1,311 (referring to SEQ ID NO:8). The nucleotide sequence of this GPR75 variant mRNA molecule is set forth in SEQ ID NO:20.

Another variant mRNA molecule of GPR75 exists, wherein a uracil is inserted at position 1,232 (referring to SEQ ID NO:9). The nucleotide sequence of this GPR75 variant mRNA molecule is set forth in SEQ ID NO:25.

Another variant mRNA molecule of GPR75 exists, wherein a uracil is inserted at position 1,471 (referring to SEQ ID NO:10). The nucleotide sequence of this GPR75 variant mRNA molecule is set forth in SEQ ID NO:30.

A variant mRNA molecule of GPR75 exists, wherein the adenine at position 830 (referring to SEQ ID NO:7) is replaced with guanine. The nucleotide sequence of this GPR75 variant mRNA molecule is set forth in SEQ ID NO:100.

Another variant mRNA molecule of GPR75 exists, wherein the adenine at position 731 (referring to SEQ ID NO:8) is replaced with guanine. The nucleotide sequence of this GPR75 variant mRNA molecule is set forth in SEQ ID NO:101.

Another variant mRNA molecule of GPR75 exists, wherein the adenine at position 652 (referring to SEQ ID NO:9) is replaced with guanine. The nucleotide sequence of this GPR75 variant mRNA molecule is set forth in SEQ ID NO:102.

Another variant mRNA molecule of GPR75 exists, wherein the adenine at position 891 (referring to SEQ ID NO:10) is replaced with guanine. The nucleotide sequence of this GPR75 variant mRNA molecule is set forth in SEQ ID NO:103.

The present disclosure also provides isolated mRNA molecules comprising or consisting of a nucleotide sequence encoding a human GPR75 polypeptide, wherein the nucleotide sequence lacks a CCAGUAG heptanucleotide at positions corresponding to positions 539-545 according to SEQ ID NO:7, or the complement thereof. An example is set forth in SEQ ID NO:11.

The present disclosure also provides isolated mRNA molecules comprising or consisting of a nucleotide sequence encoding a human GPR75 polypeptide, wherein the nucleotide sequence lacks a CCAGUAG heptanucleotide at positions corresponding to positions 440-446 according to SEQ ID NO:8, or the complement thereof. An example is set forth in SEQ ID NO:16.

The present disclosure also provides isolated mRNA molecules comprising or consisting of a nucleotide sequence encoding a human GPR75 polypeptide, wherein the nucleotide sequence lacks a CCAGUAG heptanucleotide at positions corresponding to positions 361-367 according to SEQ ID NO:9, or the complement thereof. An example is set forth in SEQ ID NO:21.

The present disclosure also provides isolated mRNA molecules comprising or consisting of a nucleotide sequence encoding a human GPR75 polypeptide, wherein the nucleotide sequence lacks a CCAGUAG heptanucleotide at positions corresponding to positions 600-606 according to SEQ ID NO:10, or the complement thereof. An example is set forth in SEQ ID NO:26.

The present disclosure also provides isolated mRNA molecules comprising or consisting of a nucleotide sequence encoding a human GPR75 polypeptide, wherein the nucleotide sequence lacks an AAAG tetranucleotide at positions corresponding to positions 919-922 according to SEQ ID NO:7, or the complement thereof. An example is set forth in SEQ ID NO:14.

The present disclosure also provides isolated mRNA molecules comprising or consisting of a nucleotide sequence encoding a human GPR75 polypeptide, wherein the nucleotide sequence lacks an AAAG tetranucleotide at positions corresponding to positions 820-823 according to SEQ ID NO:8, or the complement thereof. An example is set forth in SEQ ID NO:19.

The present disclosure also provides isolated mRNA molecules comprising or consisting of a nucleotide sequence encoding a human GPR75 polypeptide, wherein the nucleotide sequence lacks an AAAG tetranucleotide at positions corresponding to positions 741-744 according to SEQ ID NO:9, or the complement thereof. An example is set forth in SEQ ID NO:24.

The present disclosure also provides isolated mRNA molecules comprising or consisting of a nucleotide sequence encoding a human GPR75 polypeptide, wherein the nucleotide sequence lacks an AAAG tetranucleotide at positions corresponding to positions 980-983 according to SEQ ID NO:10, or the complement thereof. An example is set forth in SEQ ID NO:29.

The present disclosure also provides isolated mRNA molecules comprising or consisting of a nucleotide sequence encoding a human GPR75 polypeptide, wherein the nucleotide sequence comprises an insertion of a uracil at a position corresponding to position 1,410 according to SEQ ID NO:15, or the complement thereof.

The present disclosure also provides isolated mRNA molecules comprising or consisting of a nucleotide sequence encoding a human GPR75 polypeptide, wherein the nucleotide sequence comprises an insertion of a uracil at a position corresponding to position 1,311 according to SEQ ID NO:20, or the complement thereof.

The present disclosure also provides isolated mRNA molecules comprising or consisting of a nucleotide sequence encoding a human GPR75 polypeptide, wherein the nucleotide sequence comprises an insertion of a uracil at a position corresponding to position 1,232 according to SEQ ID NO:25, or the complement thereof.

The present disclosure also provides isolated mRNA molecules comprising or consisting of a nucleotide sequence encoding a human GPR75 polypeptide, wherein the nucleotide sequence comprises an insertion of a uracil at a position corresponding to position 1,471 according to SEQ ID NO:30, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:11, and lacks a CCAGUAG heptanucleotide at positions corresponding to positions 539-545 according to SEQ ID NO:7, or the complement thereof. In some embodiments, the isolated mRNA molecules comprise or consist of a nucleotide sequence that has at least about 90% sequence identity to SEQ ID NO:11, and lacks a CCAGUAG heptanucleotide at positions corresponding to positions 539-545 according to SEQ ID NO:7, or the complement thereof. In some embodiments, the isolated mRNA molecules comprise or consist of a nucleotide sequence that has at least about 92% sequence identity to SEQ ID NO:11, and lacks a CCAGUAG heptanucleotide at positions corresponding to positions 539-545 according to SEQ ID NO:7, or the complement thereof. In some embodiments, the isolated mRNA molecules comprise or consist of a nucleotide sequence that has at least about 94% sequence identity to SEQ ID NO:11, and lacks a CCAGUAG heptanucleotide at positions corresponding to positions 539-545 according to SEQ ID NO:7, or the complement thereof. In some embodiments, the isolated mRNA molecules comprise or consist of a nucleotide sequence that has at least about 96% sequence identity to SEQ ID NO:11, and lacks a CCAGUAG heptanucleotide at positions corresponding to positions 539-545 according to SEQ ID NO:7, or the complement thereof. In some embodiments, the isolated mRNA molecules comprise or consist of a nucleotide sequence that has at least about 98% sequence identity to SEQ ID NO:11, and lacks a CCAGUAG heptanucleotide at positions corresponding to positions 539-545 according to SEQ ID NO:7, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:16, and lacks a CCAGUAG heptanucleotide at positions corresponding to positions 440-446 according to SEQ ID NO:8, or the complement thereof. In some embodiments, the isolated mRNA molecules comprise or consist of a nucleotide sequence that has at least about 90% sequence identity to SEQ ID NO:16, and lacks a CCAGUAG heptanucleotide at positions corresponding to positions 440-446 according to SEQ ID NO:8, or the complement thereof. In some embodiments, the isolated mRNA molecules comprise or consist of a nucleotide sequence that has at least about 92% sequence identity to SEQ ID NO:16, and lacks a CCAGUAG heptanucleotide at positions corresponding to positions 440-446 according to SEQ ID NO:8, or the complement thereof. In some embodiments, the isolated mRNA molecules comprise or consist of a nucleotide sequence that has at least about 94% sequence identity to SEQ ID NO:16, and lacks a CCAGUAG heptanucleotide at positions corresponding to positions 440-446 according to SEQ ID NO:8, or the complement thereof. In some embodiments, the isolated mRNA molecules comprise or consist of a nucleotide sequence that has at least about 96% sequence identity to SEQ ID NO:16, and lacks a CCAGUAG heptanucleotide at positions corresponding to positions 440-446 according to SEQ ID NO:8, or the complement thereof. In some embodiments, the isolated mRNA molecules comprise or consist of a nucleotide sequence that has at least about 98% sequence identity to SEQ ID NO:16, and lacks a CCAGUAG heptanucleotide at positions corresponding to positions 440-446 according to SEQ ID NO:7, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:21, and lacks a CCAGUAG heptanucleotide at positions corresponding to positions 361-367 according to SEQ ID NO:9, or the complement thereof. In some embodiments, the isolated mRNA molecules comprise or consist of a nucleotide sequence that has at least about 90% sequence identity to SEQ ID NO:21, and lacks a CCAGUAG heptanucleotide at positions corresponding to positions 361-367 according to SEQ ID NO:9, or the complement thereof. In some embodiments, the isolated mRNA molecules comprise or consist of a nucleotide sequence that has at least about 92% sequence identity to SEQ ID NO:21, and lacks a CCAGUAG heptanucleotide at positions corresponding to positions 361-367 according to SEQ ID NO:9, or the complement thereof. In some embodiments, the isolated mRNA molecules comprise or consist of a nucleotide sequence that has at least about 94% sequence identity to SEQ ID NO:21, and lacks a CCAGUAG heptanucleotide at positions corresponding to positions 361-367 according to SEQ ID NO:9, or the complement thereof. In some embodiments, the isolated mRNA molecules comprise or consist of a nucleotide sequence that has at least about 96% sequence identity to SEQ ID NO:21, and lacks a CCAGUAG heptanucleotide at positions corresponding to positions 361-367 according to SEQ ID NO:9, or the complement thereof. In some embodiments, the isolated mRNA molecules comprise or consist of a nucleotide sequence that has at least about 98% sequence identity to SEQ ID NO:21, and lacks a CCAGUAG heptanucleotide at positions corresponding to positions 361-367 according to SEQ ID NO:9, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:26, and lacks a CCAGUAG heptanucleotide at positions corresponding to positions 600-606 according to SEQ ID NO:10, or the complement thereof. In some embodiments, the isolated mRNA molecules comprise or consist of a nucleotide sequence that has at least about 90% sequence identity to SEQ ID NO:26, and lacks a CCAGUAG heptanucleotide at positions corresponding to positions 600-606 according to SEQ ID NO:10, or the complement thereof. In some embodiments, the isolated mRNA molecules comprise or consist of a nucleotide sequence that has at least about 92% sequence identity to SEQ ID NO:26, and lacks a CCAGUAG heptanucleotide at positions corresponding to positions 600-606 according to SEQ ID NO:10, or the complement thereof. In some embodiments, the isolated mRNA molecules comprise or consist of a nucleotide sequence that has at least about 94% sequence identity to SEQ ID NO:26, and lacks a CCAGUAG heptanucleotide at positions corresponding to positions 600-606 according to SEQ ID NO:10, or the complement thereof. In some embodiments, the isolated mRNA molecules comprise or consist of a nucleotide sequence that has at least about 96% sequence identity to SEQ ID NO:26, and lacks a CCAGUAG heptanucleotide at positions corresponding to positions 600-606 according to SEQ ID NO:10, or the complement thereof. In some embodiments, the isolated mRNA molecules comprise or consist of a nucleotide sequence that has at least about 98% sequence identity to SEQ ID NO:26, and lacks a CCAGUAG heptanucleotide at positions corresponding to positions 600-606 according to SEQ ID NO:10, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:14, and lacks an AAAG tetranucleotide at positions corresponding to positions 919-922 according to SEQ ID NO:7, or the complement thereof. In some embodiments, the isolated mRNA molecules comprise or consist of a nucleotide sequence that has at least about 90% sequence identity to SEQ ID NO:14, and lacks an AAAG tetranucleotide at positions corresponding to positions 919-922 according to SEQ ID NO:7, or the complement thereof. In some embodiments, the isolated mRNA molecules comprise or consist of a nucleotide sequence that has at least about 92% sequence identity to SEQ ID NO:14, and lacks an AAAG tetranucleotide at positions corresponding to positions 919-922 according to SEQ ID NO:7, or the complement thereof. In some embodiments, the isolated mRNA molecules comprise or consist of a nucleotide sequence that has at least about 94% sequence identity to SEQ ID NO:14, and lacks an AAAG tetranucleotide at positions corresponding to positions 919-922 according to SEQ ID NO:7, or the complement thereof. In some embodiments, the isolated mRNA molecules comprise or consist of a nucleotide sequence that has at least about 96% sequence identity to SEQ ID NO:14, and lacks an AAAG tetranucleotide at positions corresponding to positions 919-922 according to SEQ ID NO:7, or the complement thereof. In some embodiments, the isolated mRNA molecules comprise or consist of a nucleotide sequence that has at least about 98% sequence identity to SEQ ID NO:14, and lacks an AAAG tetranucleotide at positions corresponding to positions 919-922 according to SEQ ID NO:7, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:19, and lacks an AAAG tetranucleotide at positions corresponding to positions 820-823 according to SEQ ID NO:8, or the complement thereof. In some embodiments, the isolated mRNA molecules comprise or consist of a nucleotide sequence that has at least about 90% sequence identity to SEQ ID NO:19, and lacks an AAAG tetranucleotide at positions corresponding to positions 820-823 according to SEQ ID NO:8, or the complement thereof. In some embodiments, the isolated mRNA molecules comprise or consist of a nucleotide sequence that has at least about 92% sequence identity to SEQ ID NO:19, and lacks an AAAG tetranucleotide at positions corresponding to positions 820-823 according to SEQ ID NO:8, or the complement thereof. In some embodiments, the isolated mRNA molecules comprise or consist of a nucleotide sequence that has at least about 94% sequence identity to SEQ ID NO:19, and lacks an AAAG tetranucleotide at positions corresponding to positions 820-823 according to SEQ ID NO:8, or the complement thereof. In some embodiments, the isolated mRNA molecules comprise or consist of a nucleotide sequence that has at least about 96% sequence identity to SEQ ID NO:19, and lacks an AAAG tetranucleotide at positions corresponding to positions 820-823 according to SEQ ID NO:8, or the complement thereof. In some embodiments, the isolated mRNA molecules comprise or consist of a nucleotide sequence that has at least about 98% sequence identity to SEQ ID NO:19, and lacks an AAAG tetranucleotide at positions corresponding to positions 820-823 according to SEQ ID NO:8, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:24, and lacks an AAAG tetranucleotide at positions corresponding to positions 741-744 according to SEQ ID NO:9, or the complement thereof. In some embodiments, the isolated mRNA molecules comprise or consist of a nucleotide sequence that has at least about 90% sequence identity to SEQ ID NO:24, and lacks an AAAG tetranucleotide at positions corresponding to positions 741-744 according to SEQ ID NO:9, or the complement thereof. In some embodiments, the isolated mRNA molecules comprise or consist of a nucleotide sequence that has at least about 92% sequence identity to SEQ ID NO:24, and lacks an AAAG tetranucleotide at positions corresponding to positions 741-744 according to SEQ ID NO:9, or the complement thereof. In some embodiments, the isolated mRNA molecules comprise or consist of a nucleotide sequence that has at least about 94% sequence identity to SEQ ID NO:24, and lacks an AAAG tetranucleotide at positions corresponding to positions 741-744 according to SEQ ID NO:9, or the complement thereof. In some embodiments, the isolated mRNA molecules comprise or consist of a nucleotide sequence that has at least about 96% sequence identity to SEQ ID NO:24, and lacks an AAAG tetranucleotide at positions corresponding to positions 741-744 according to SEQ ID NO:9, or the complement thereof. In some embodiments, the isolated mRNA molecules comprise or consist of a nucleotide sequence that has at least about 98% sequence identity to SEQ ID NO:24, and lacks an AAAG tetranucleotide at positions corresponding to positions 741-744 according to SEQ ID NO:9, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:29, and lacks an AAAG tetranucleotide at positions corresponding to positions 980-983 according to SEQ ID NO:10, or the complement thereof. In some embodiments, the isolated mRNA molecules comprise or consist of a nucleotide sequence that has at least about 90% sequence identity to SEQ ID NO:29, and lacks an AAAG tetranucleotide at positions corresponding to positions 980-983 according to SEQ ID NO:10, or the complement thereof. In some embodiments, the isolated mRNA molecules comprise or consist of a nucleotide sequence that has at least about 92% sequence identity to SEQ ID NO:29, and lacks an AAAG tetranucleotide at positions corresponding to positions 980-983 according to SEQ ID NO:10, or the complement thereof. In some embodiments, the isolated mRNA molecules comprise or consist of a nucleotide sequence that has at least about 94% sequence identity to SEQ ID NO:29, and lacks an AAAG tetranucleotide at positions corresponding to positions 980-983 according to SEQ ID NO:10, or the complement thereof. In some embodiments, the isolated mRNA molecules comprise or consist of a nucleotide sequence that has at least about 96% sequence identity to SEQ ID NO:29, and lacks an AAAG tetranucleotide at positions corresponding to positions 980-983 according to SEQ ID NO:10, or the complement thereof. In some embodiments, the isolated mRNA molecules comprise or consist of a nucleotide sequence that has at least about 98% sequence identity to SEQ ID NO:29, and lacks an AAAG tetranucleotide at positions corresponding to positions 980-983 according to SEQ ID NO:10, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:15, and comprises an insertion of a uracil at a position corresponding to position 1,410 according to SEQ ID NO:15, or the complement thereof. In some embodiments, the isolated mRNA molecules comprise or consist of a nucleotide sequence that has at least about 90% sequence identity to SEQ ID NO:15, and comprises an insertion of a uracil at a position corresponding to position 1,410 according to SEQ ID NO:15, or the complement thereof. In some embodiments, the isolated mRNA molecules comprise or consist of a nucleotide sequence that has at least about 92% sequence identity to SEQ ID NO:15, and comprises an insertion of a uracil at a position corresponding to position 1,410 according to SEQ ID NO:15, or the complement thereof. In some embodiments, the isolated mRNA molecules comprise or consist of a nucleotide sequence that has at least about 94% sequence identity to SEQ ID NO:15, and comprises an insertion of a uracil at a position corresponding to position 1,410 according to SEQ ID NO:15, or the complement thereof. In some embodiments, the isolated mRNA molecules comprise or consist of a nucleotide sequence that has at least about 96% sequence identity to SEQ ID NO:15, and comprises an insertion of a uracil at a position corresponding to position 1,410 according to SEQ ID NO:15, or the complement thereof. In some embodiments, the isolated mRNA molecules comprise or consist of a nucleotide sequence that has at least about 98% sequence identity to SEQ ID NO:15, and comprises an insertion of a uracil at a position corresponding to position 1,410 according to SEQ ID NO:15, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:20, and comprises an insertion of a uracil at a position corresponding to position 1,311 according to SEQ ID NO:20, or the complement thereof. In some embodiments, the isolated mRNA molecules comprise or consist of a nucleotide sequence that has at least about 90% sequence identity to SEQ ID NO:20, and comprises an insertion of a uracil at a position corresponding to position 1,311 according to SEQ ID NO:20, or the complement thereof. In some embodiments, the isolated mRNA molecules comprise or consist of a nucleotide sequence that has at least about 92% sequence identity to SEQ ID NO:20, and comprises an insertion of a uracil at a position corresponding to position 1,311 according to SEQ ID NO:20, or the complement thereof. In some embodiments, the isolated mRNA molecules comprise or consist of a nucleotide sequence that has at least about 94% sequence identity to SEQ ID NO:20, and comprises an insertion of a uracil at a position corresponding to position 1,311 according to SEQ ID NO:20, or the complement thereof. In some embodiments, the isolated mRNA molecules comprise or consist of a nucleotide sequence that has at least about 96% sequence identity to SEQ ID NO:20, and comprises an insertion of a uracil at a position corresponding to position 1,311 according to SEQ ID NO:20, or the complement thereof. In some embodiments, the isolated mRNA molecules comprise or consist of a nucleotide sequence that has at least about 98% sequence identity to SEQ ID NO:20, and comprises an insertion of a uracil at a position corresponding to position 1,311 according to SEQ ID NO:20, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:25, and comprises an insertion of a uracil at a position corresponding to position 1,232 according to SEQ ID NO:25, or the complement thereof. In some embodiments, the isolated mRNA molecules comprise or consist of a nucleotide sequence that has at least about 90% sequence identity to SEQ ID NO:25, and comprises an insertion of a uracil at a position corresponding to position 1,232 according to SEQ ID NO:25, or the complement thereof. In some embodiments, the isolated mRNA molecules comprise or consist of a nucleotide sequence that has at least about 92% sequence identity to SEQ ID NO:25, and comprises an insertion of a uracil at a position corresponding to position 1,232 according to SEQ ID NO:25, or the complement thereof. In some embodiments, the isolated mRNA molecules comprise or consist of a nucleotide sequence that has at least about 94% sequence identity to SEQ ID NO:25, and comprises an insertion of a uracil at a position corresponding to position 1,232 according to SEQ ID NO:25, or the complement thereof. In some embodiments, the isolated mRNA molecules comprise or consist of a nucleotide sequence that has at least about 96% sequence identity to SEQ ID NO:25, and comprises an insertion of a uracil at a position corresponding to position 1,232 according to SEQ ID NO:25, or the complement thereof. In some embodiments, the isolated mRNA molecules comprise or consist of a nucleotide sequence that has at least about 98% sequence identity to SEQ ID NO:25, and comprises an insertion of a uracil at a position corresponding to position 1,232 according to SEQ ID NO:25, or the complement thereof.

In some embodiments, the isolated mRNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:30, and comprises an insertion of a uracil at a position corresponding to position 1,471 according to SEQ ID NO:30, or the complement thereof. In some embodiments, the isolated mRNA molecules comprise or consist of a nucleotide sequence that has at least about 90% sequence identity to SEQ ID NO:30, and comprises an insertion of a uracil at a position corresponding to position 1,471 according to SEQ ID NO:30, or the complement thereof. In some embodiments, the isolated mRNA molecules comprise or consist of a nucleotide sequence that has at least about 92% sequence identity to SEQ ID NO:30, and comprises an insertion of a uracil at a position corresponding to position 1,471 according to SEQ ID NO:30, or the complement thereof. In some embodiments, the isolated mRNA molecules comprise or consist of a nucleotide sequence that has at least about 94% sequence identity to SEQ ID NO:30, and comprises an insertion of a uracil at a position corresponding to position 1,471 according to SEQ ID NO:30, or the complement thereof. In some embodiments, the isolated mRNA molecules comprise or consist of a nucleotide sequence that has at least about 96% sequence identity to SEQ ID NO:30, and comprises an insertion of a uracil at a position corresponding to position 1,471 according to SEQ ID NO:30, or the complement thereof. In some embodiments, the isolated mRNA molecules comprise or consist of a nucleotide sequence that has at least about 98% sequence identity to SEQ ID NO:30, and comprises an insertion of a uracil at a position corresponding to position 1,471 according to SEQ ID NO:30, or the complement thereof.

Herein, if reference is made to percent sequence identity, the higher percentages of sequence identity are preferred over the lower ones.

In some embodiments, the isolated mRNA molecules comprise SEQ ID NO:11. In some embodiments, the isolated mRNA molecules consist of SEQ ID NO:11. In some embodiments, the isolated mRNA molecules comprise SEQ ID NO:16. In some embodiments, the isolated mRNA molecules consist of SEQ ID NO:16. In some embodiments, the isolated mRNA molecules comprise SEQ ID NO:21. In some embodiments, the isolated mRNA molecules consist of SEQ ID NO:21. In some embodiments, the isolated mRNA molecules comprise SEQ ID NO:26. In some embodiments, the isolated mRNA molecules consist of SEQ ID NO:26

In some embodiments, the isolated mRNA molecules comprise SEQ ID NO:14. In some embodiments, the isolated mRNA molecules consist of SEQ ID NO:14. In some embodiments, the isolated mRNA molecules comprise SEQ ID NO:19. In some embodiments, the isolated mRNA molecules consist of SEQ ID NO:19. In some embodiments, the isolated mRNA molecules comprise SEQ ID NO:24. In some embodiments, the isolated mRNA molecules consist of SEQ ID NO:24. In some embodiments, the isolated mRNA molecules comprise SEQ ID NO:29. In some embodiments, the isolated mRNA molecules consist of SEQ ID NO:29.

In some embodiments, the isolated mRNA molecules comprise SEQ ID NO:15. In some embodiments, the isolated mRNA molecules consist of SEQ ID NO:15. In some embodiments, the isolated mRNA molecules comprise SEQ ID NO:20. In some embodiments, the isolated mRNA molecules consist of SEQ ID NO:20. In some embodiments, the isolated mRNA molecules comprise SEQ ID NO:25. In some embodiments, the isolated mRNA molecules consist of SEQ ID NO:25. In some embodiments, the isolated mRNA molecules comprise SEQ ID NO:30. In some embodiments, the isolated mRNA molecules consist of SEQ ID NO:30.

The nucleotide sequence of a GPR75 reference cDNA molecule is set forth in SEQ ID NO:31. Referring to SEQ ID NO:31, positions 539-545 are a CCAGTAG heptanucleotide. Referring to SEQ ID NO:31, position 556 is a guanine. Referring to SEQ ID NO:31, position 910 is a cytosine. Referring to SEQ ID NO:31, positions 919-922 are an AAAG tetranucleotide. Referring to SEQ ID NO:31, position 1,410 is a cytosine. Referring to SEQ ID NO:31, position 830 is an adenine.

The nucleotide sequence of another GPR75 reference cDNA molecule is set forth in SEQ ID NO:32. Referring to SEQ ID NO:32, positions 440-446 are a CCAGTAG heptanucleotide. Referring to SEQ ID NO:32, position 457 is a guanine. Referring to SEQ ID NO:32, position 811 is a cytosine. Referring to SEQ ID NO:32, positions 820-823 are an AAAG tetranucleotide. Referring to SEQ ID NO:32, position 1,311 is a cytosine. Referring to SEQ ID NO:32, position 731 is an adenine.

The nucleotide sequence of another GPR75 reference cDNA molecule is set forth in SEQ ID NO:33. Referring to SEQ ID NO:33, positions 361-367 are a CCAGTAG heptanucleotide. Referring to SEQ ID NO:33, position 378 is a guanine. Referring to SEQ ID NO:33, position 732 is a cytosine. Referring to SEQ ID NO:33, positions 741-744 are an AAAG tetranucleotide. Referring to SEQ ID NO:33, position 1,232 is a cytosine. Referring to SEQ ID NO:33, position 652 is an adenine.

The nucleotide sequence of another GPR75 reference cDNA molecule is set forth in SEQ ID NO:34. Referring to SEQ ID NO:34, positions 600-606 are a CCAGTAG heptanucleotide. Referring to SEQ ID NO:34, position 617 is a guanine. Referring to SEQ ID NO:34, position 971 is a cytosine. Referring to SEQ ID NO:34, positions 980-983 are an AAAG tetranucleotide. Referring to SEQ ID NO:34, position 1,471 is a cytosine. Referring to SEQ ID NO:34, position 891 is an adenine.

A variant cDNA molecule of GPR75 exists, wherein the CCAGTAG heptanucleotide at positions 539-545 (referring to SEQ ID NO:31) is deleted. The nucleotide sequence of this GPR75 variant cDNA molecule is set forth in SEQ ID NO:35.

Another variant cDNA molecule of GPR75 exists, wherein the CCAGTAG heptanucleotide at positions 440-446 (referring to SEQ ID NO:32) is deleted. The nucleotide sequence of this GPR75 variant cDNA molecule is set forth in SEQ ID NO:40.

Another variant cDNA molecule of GPR75 exists, wherein the CCAGTAG heptanucleotide at positions 361-367 (referring to SEQ ID NO:33) is deleted. The nucleotide sequence of this GPR75 variant cDNA molecule is set forth in SEQ ID NO:45.

Another variant cDNA molecule of GPR75 exists, wherein the CCAGTAG heptanucleotide at positions 600-606 (referring to SEQ ID NO:34) is deleted. The nucleotide sequence of this GPR75 variant cDNA molecule is set forth in SEQ ID NO:50.

A variant cDNA molecule of GPR75 exists, wherein the guanine at position 556 (referring to SEQ ID NO:31) is replaced with adenine. The nucleotide sequence of this GPR75 variant cDNA molecule is set forth in SEQ ID NO:36.

Another variant cDNA molecule of GPR75 exists, wherein the guanine at position 457 (referring to SEQ ID NO:32) is replaced with adenine. The nucleotide sequence of this GPR75 variant cDNA molecule is set forth in SEQ ID NO:41.

Another variant cDNA molecule of GPR75 exists, wherein the guanine at position 378 (referring to SEQ ID NO:33) is replaced with adenine. The nucleotide sequence of this GPR75 variant cDNA molecule is set forth in SEQ ID NO:46.

Another variant cDNA molecule of GPR75 exists, wherein the guanine at position 617 (referring to SEQ ID NO:34) is replaced with adenine. The nucleotide sequence of this GPR75 variant cDNA molecule is set forth in SEQ ID NO:51.

A variant cDNA molecule of GPR75 exists, wherein the cytosine at position 910 (referring to SEQ ID NO:31) is replaced with thymine. The nucleotide sequence of this GPR75 variant cDNA molecule is set forth in SEQ ID NO:37.

Another variant cDNA molecule of GPR75 exists, wherein the cytosine at position 811 (referring to SEQ ID NO:32) is replaced with thymine. The nucleotide sequence of this GPR75 variant cDNA molecule is set forth in SEQ ID NO:42.

Another variant cDNA molecule of GPR75 exists, wherein the cytosine at position 732 (referring to SEQ ID NO:33) is replaced with thymine. The nucleotide sequence of this GPR75 variant cDNA molecule is set forth in SEQ ID NO:47.

Another variant cDNA molecule of GPR75 exists, wherein the cytosine at position 971 (referring to SEQ ID NO:34) is replaced with thymine. The nucleotide sequence of this GPR75 variant cDNA molecule is set forth in SEQ ID NO:52.

A variant cDNA molecule of GPR75 exists, wherein the AGCC tetranucleotide at positions 919-922 (referring to SEQ ID NO:31) is deleted. The nucleotide sequence of this GPR75 variant cDNA molecule is set forth in SEQ ID NO:38.

Another variant cDNA molecule of GPR75 exists, wherein the AGCC tetranucleotide at positions 820-823 (referring to SEQ ID NO:32) is deleted. The nucleotide sequence of this GPR75 variant cDNA molecule is set forth in SEQ ID NO:43.

Another variant cDNA molecule of GPR75 exists, wherein the AGCC tetranucleotide at positions 741-744 (referring to SEQ ID NO:33) is deleted. The nucleotide sequence of this GPR75 variant cDNA molecule is set forth in SEQ ID NO:48.

Another variant cDNA molecule of GPR75 exists, wherein the AGCC tetranucleotide at positions 980-983 (referring to SEQ ID NO:34) is replaced with deleted. The nucleotide sequence of this GPR75 variant cDNA molecule is set forth in SEQ ID NO:53.

A variant cDNA molecule of GPR75 exists, wherein a thymine is inserted at position 1,410. The nucleotide sequence of this GPR75 variant cDNA molecule is set forth in SEQ ID NO:39.

Another variant cDNA molecule of GPR75 exists, wherein a thymine is inserted at position 1,311. The nucleotide sequence of this GPR75 variant cDNA molecule is set forth in SEQ ID NO:44.

Another variant cDNA molecule of GPR75 exists, wherein a thymine is inserted at position 1,232. The nucleotide sequence of this GPR75 variant cDNA molecule is set forth in SEQ ID NO:49.

Another variant cDNA molecule of GPR75 exists, wherein a thymine is inserted at position 1,471. The nucleotide sequence of this GPR75 variant cDNA molecule is set forth in SEQ ID NO:54.

A variant cDNA molecule of GPR75 exists, wherein the adenine at position 830 (referring to SEQ ID NO:31) is replaced with guanine. The nucleotide sequence of this GPR75 variant cDNA molecule is set forth in SEQ ID NO:104.

Another variant cDNA molecule of GPR75 exists, wherein the adenine at position 731 (referring to SEQ ID NO:32) is replaced with guanine. The nucleotide sequence of this GPR75 variant cDNA molecule is set forth in SEQ ID NO:105.

Another variant cDNA molecule of GPR75 exists, wherein the adenine at position 652 (referring to SEQ ID NO:33) is replaced with guanine. The nucleotide sequence of this GPR75 variant cDNA molecule is set forth in SEQ ID NO:106.

Another variant cDNA molecule of GPR75 exists, wherein the adenine at position 891 (referring to SEQ ID NO:34) is replaced with guanine. The nucleotide sequence of this GPR75 variant cDNA molecule is set forth in SEQ ID NO:107.

The present disclosure also provides isolated cDNA molecules comprising or consisting of a nucleotide sequence encoding a human GPR75 polypeptide, wherein the nucleotide sequence lacks a CCAGTAG heptanucleotide at positions corresponding to positions 539-545 according to SEQ ID NO:31, or the complement thereof. An example is set forth in SEQ ID NO:35.

The present disclosure also provides isolated cDNA molecules comprising or consisting of a nucleotide sequence encoding a human GPR75 polypeptide, wherein the nucleotide sequence lacks a CCAGTAG heptanucleotide at positions corresponding to positions 440-446 according to SEQ ID NO:32, or the complement thereof. An example is set forth in SE ID NO:40.

The present disclosure also provides isolated cDNA molecules comprising or consisting of a nucleotide sequence encoding a human GPR75 polypeptide, wherein the nucleotide sequence lacks a CCAGTAG heptanucleotide at positions corresponding to positions 361-367 according to SEQ ID NO:43, or the complement thereof. An example is set forth in SE ID NO:45.

The present disclosure also provides isolated cDNA molecules comprising or consisting of a nucleotide sequence encoding a human GPR75 polypeptide, wherein the nucleotide sequence lacks a CCAGTAG heptanucleotide at positions corresponding to positions 600-606 according to SEQ ID NO:34, or the complement thereof. An example is set forth in SE ID NO:50.

The present disclosure also provides isolated cDNA molecules comprising or consisting of a nucleotide sequence encoding a human GPR75 polypeptide, wherein the nucleotide sequence lacks an AAAG tetranucleotide at positions corresponding to positions 919-922 according to SEQ ID NO:31, or the complement thereof. An example is set forth in SE ID NO:38.

The present disclosure also provides isolated cDNA molecules comprising or consisting of a nucleotide sequence encoding a human GPR75 polypeptide, wherein the nucleotide sequence lacks an AAAG tetranucleotide at positions corresponding to positions 820-823 according to SEQ ID NO:32, or the complement thereof. An example is set forth in SE ID NO:43.

The present disclosure also provides isolated cDNA molecules comprising or consisting of a nucleotide sequence encoding a human GPR75 polypeptide, wherein the nucleotide sequence lacks an AAAG tetranucleotide at positions corresponding to positions 741-744 according to SEQ ID NO:33, or the complement thereof. An example is set forth in SE ID NO:48.

The present disclosure also provides isolated cDNA molecules comprising or consisting of a nucleotide sequence encoding a human GPR75 polypeptide, wherein the nucleotide sequence lacks an AAAG tetranucleotide at positions corresponding to positions 980-983 according to SEQ ID NO:34, or the complement thereof. An example is set forth in SE ID NO:53.

The present disclosure also provides isolated cDNA molecules comprising or consisting of a nucleotide sequence encoding a human GPR75 polypeptide, wherein the nucleotide sequence comprises an insertion of a thymine at a position corresponding to position 1,410 according to SEQ ID NO:39, or the complement thereof.

The present disclosure also provides isolated cDNA molecules comprising or consisting of a nucleotide sequence encoding a human GPR75 polypeptide, wherein the nucleotide sequence comprises an insertion of a thymine at a position corresponding to position 1,311 according to SEQ ID NO:44, or the complement thereof.

The present disclosure also provides isolated cDNA molecules comprising or consisting of a nucleotide sequence encoding a human GPR75 polypeptide, wherein the nucleotide sequence comprises an insertion of a thymine at a position corresponding to position 1,232 according to SEQ ID NO:49, or the complement thereof.

The present disclosure also provides isolated cDNA molecules comprising or consisting of a nucleotide sequence encoding a human GPR75 polypeptide, wherein the nucleotide sequence comprises or an insertion of a thymine at a position corresponding to position 1,471 according to SEQ ID NO:54, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:35, and lacks a CCAGTAG heptanucleotide at positions corresponding to positions 539-545 according to SEQ ID NO:31, or the complement thereof. In some embodiments, the isolated cDNA molecules comprise or consist of a nucleotide sequence that has at least about 90% sequence identity to SEQ ID NO:35, and lacks a CCAGTAG heptanucleotide at positions corresponding to positions 539-545 according to SEQ ID NO:31, or the complement thereof. In some embodiments, the isolated cDNA molecules comprise or consist of a nucleotide sequence that has at least about 92% sequence identity to SEQ ID NO:35, and lacks a CCAGTAG heptanucleotide at positions corresponding to positions 539-545 according to SEQ ID NO:31, or the complement thereof. In some embodiments, the isolated cDNA molecules comprise or consist of a nucleotide sequence that has at least about 94% sequence identity to SEQ ID NO:35, and lacks a CCAGTAG heptanucleotide at positions corresponding to positions 539-545 according to SEQ ID NO:31, or the complement thereof. In some embodiments, the isolated cDNA molecules comprise or consist of a nucleotide sequence that has at least about 96% sequence identity to SEQ ID NO:35, and lacks a CCAGTAG heptanucleotide at positions corresponding to positions 539-545 according to SEQ ID NO:31, or the complement thereof. In some embodiments, the isolated cDNA molecules comprise or consist of a nucleotide sequence that has at least about 98% sequence identity to SEQ ID NO:35, and lacks a CCAGTAG heptanucleotide at positions corresponding to positions 539-545 according to SEQ ID NO:31, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:40, and lacks a CCAGTAG heptanucleotide at positions corresponding to positions 440-446 according to SEQ ID NO:32, or the complement thereof. In some embodiments, the isolated cDNA molecules comprise or consist of a nucleotide sequence that has at least about 90% sequence identity to SEQ ID NO:40, and lacks a CCAGTAG heptanucleotide at positions corresponding to positions 440-446 according to SEQ ID NO:32, or the complement thereof. In some embodiments, the isolated cDNA molecules comprise or consist of a nucleotide sequence that has at least about 92% sequence identity to SEQ ID NO:40, and lacks a CCAGTAG heptanucleotide at positions corresponding to positions 440-446 according to SEQ ID NO:32, or the complement thereof. In some embodiments, the isolated cDNA molecules comprise or consist of a nucleotide sequence that has at least about 94% sequence identity to SEQ ID NO:40, and lacks a CCAGTAG heptanucleotide at positions corresponding to positions 440-446 according to SEQ ID NO:32, or the complement thereof. In some embodiments, the isolated cDNA molecules comprise or consist of a nucleotide sequence that has at least about 96% sequence identity to SEQ ID NO:40, and lacks a CCAGTAG heptanucleotide at positions corresponding to positions 440-446 according to SEQ ID NO:32, or the complement thereof. In some embodiments, the isolated cDNA molecules comprise or consist of a nucleotide sequence that has at least about 98% sequence identity to SEQ ID NO:40, and lacks a CCAGTAG heptanucleotide at positions corresponding to positions 440-446 according to SEQ ID NO:32, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:45, and lacks a CCAGTAG heptanucleotide at positions corresponding to positions 361-367 according to SEQ ID NO:33, or the complement thereof. In some embodiments, the isolated cDNA molecules comprise or consist of a nucleotide sequence that has at least about 90% sequence identity to SEQ ID NO:45, and lacks a CCAGTAG heptanucleotide at positions corresponding to positions 361-367 according to SEQ ID NO:33, or the complement thereof. In some embodiments, the isolated cDNA molecules comprise or consist of a nucleotide sequence that has at least about 92% sequence identity to SEQ ID NO:45, and lacks a CCAGTAG heptanucleotide at positions corresponding to positions 361-367 according to SEQ ID NO:33, or the complement thereof. In some embodiments, the isolated cDNA molecules comprise or consist of a nucleotide sequence that has at least about 94% sequence identity to SEQ ID NO:45, and lacks a CCAGTAG heptanucleotide at positions corresponding to positions 361-367 according to SEQ ID NO:33, or the complement thereof. In some embodiments, the isolated cDNA molecules comprise or consist of a nucleotide sequence that has at least about 96% sequence identity to SEQ ID NO:45, and lacks a CCAGTAG heptanucleotide at positions corresponding to positions 361-367 according to SEQ ID NO:33, or the complement thereof. In some embodiments, the isolated cDNA molecules comprise or consist of a nucleotide sequence that has at least about 98% sequence identity to SEQ ID NO:45, and lacks a CCAGTAG heptanucleotide at positions corresponding to positions 361-367 according to SEQ ID NO:33, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:50, and lacks a CCAGTAG heptanucleotide at positions corresponding to positions 600-606 according to SEQ ID NO:34, or the complement thereof. In some embodiments, the isolated cDNA molecules comprise or consist of a nucleotide sequence that has at least about 90% sequence identity to SEQ ID NO:50, and lacks a CCAGTAG heptanucleotide at positions corresponding to positions 600-606 according to SEQ ID NO:34, or the complement thereof. In some embodiments, the isolated cDNA molecules comprise or consist of a nucleotide sequence that has at least about 92% sequence identity to SEQ ID NO:50, and lacks a CCAGTAG heptanucleotide at positions corresponding to positions 600-606 according to SEQ ID NO:34, or the complement thereof. In some embodiments, the isolated cDNA molecules comprise or consist of a nucleotide sequence that has at least about 94% sequence identity to SEQ ID NO:50, and lacks a CCAGTAG heptanucleotide at positions corresponding to positions 600-606 according to SEQ ID NO:34, or the complement thereof. In some embodiments, the isolated cDNA molecules comprise or consist of a nucleotide sequence that has at least about 96% sequence identity to SEQ ID NO:50, and lacks a CCAGTAG heptanucleotide at positions corresponding to positions 600-606 according to SEQ ID NO:34, or the complement thereof. In some embodiments, the isolated cDNA molecules comprise or consist of a nucleotide sequence that has at least about 98% sequence identity to SEQ ID NO:50, and lacks a CCAGTAG heptanucleotide at positions corresponding to positions 600-606 according to SEQ ID NO:34, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:38, and lacks an AAAG tetranucleotide at positions corresponding to positions 919-922 according to SEQ ID NO:31, or the complement thereof. In some embodiments, the isolated cDNA molecules comprise or consist of a nucleotide sequence that has at least about 90% sequence identity to SEQ ID NO:38, and lacks an AAAG tetranucleotide at positions corresponding to positions 919-922 according to SEQ ID NO:31, or the complement thereof. In some embodiments, the isolated cDNA molecules comprise or consist of a nucleotide sequence that has at least about 92% sequence identity to SEQ ID NO:38, and lacks an AAAG tetranucleotide at positions corresponding to positions 919-922 according to SEQ ID NO:31, or the complement thereof. In some embodiments, the isolated cDNA molecules comprise or consist of a nucleotide sequence that has at least about 94% sequence identity to SEQ ID NO:38, and lacks an AAAG tetranucleotide at positions corresponding to positions 919-922 according to SEQ ID NO:31, or the complement thereof. In some embodiments, the isolated cDNA molecules comprise or consist of a nucleotide sequence that has at least about 96% sequence identity to SEQ ID NO:38, and lacks an AAAG tetranucleotide at positions corresponding to positions 919-922 according to SEQ ID NO:31, or the complement thereof. In some embodiments, the isolated cDNA molecules comprise or consist of a nucleotide sequence that has at least about 98% sequence identity to SEQ ID NO:38, and lacks an AAAG tetranucleotide at positions corresponding to positions 919-922 according to SEQ ID NO:31, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:43, and lacks an AAAG tetranucleotide at positions corresponding to positions 820-823 according to SEQ ID NO:32, or the complement thereof. In some embodiments, the isolated cDNA molecules comprise or consist of a nucleotide sequence that has at least about 90% sequence identity to SEQ ID NO:43, and lacks an AAAG tetranucleotide at positions corresponding to positions 820-823 according to SEQ ID NO:32, or the complement thereof. In some embodiments, the isolated cDNA molecules comprise or consist of a nucleotide sequence that has at least about 92% sequence identity to SEQ ID NO:43, and lacks an AAAG tetranucleotide at positions corresponding to positions 820-823 according to SEQ ID NO:32, or the complement thereof. In some embodiments, the isolated cDNA molecules comprise or consist of a nucleotide sequence that has at least about 94% sequence identity to SEQ ID NO:43, and lacks an AAAG tetranucleotide at positions corresponding to positions 820-823 according to SEQ ID NO:32, or the complement thereof. In some embodiments, the isolated cDNA molecules comprise or consist of a nucleotide sequence that has at least about 96% sequence identity to SEQ ID NO:43, and lacks an AAAG tetranucleotide at positions corresponding to positions 820-823 according to SEQ ID NO:32, or the complement thereof. In some embodiments, the isolated cDNA molecules comprise or consist of a nucleotide sequence that has at least about 98% sequence identity to SEQ ID NO:43, and lacks an AAAG tetranucleotide at positions corresponding to positions 820-823 according to SEQ ID NO:32, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:48, and lacks an AAAG tetranucleotide at positions corresponding to positions 741-744 according to SEQ ID NO:33, or the complement thereof. In some embodiments, the isolated cDNA molecules comprise or consist of a nucleotide sequence that has at least about 90% sequence identity to SEQ ID NO:48, and lacks an AAAG tetranucleotide at positions corresponding to positions 741-744 according to SEQ ID NO:33, or the complement thereof. In some embodiments, the isolated cDNA molecules comprise or consist of a nucleotide sequence that has at least about 92% sequence identity to SEQ ID NO:48, and lacks an AAAG tetranucleotide at positions corresponding to positions 741-744 according to SEQ ID NO:33, or the complement thereof. In some embodiments, the isolated cDNA molecules comprise or consist of a nucleotide sequence that has at least about 94% sequence identity to SEQ ID NO:48, and lacks an AAAG tetranucleotide at positions corresponding to positions 741-744 according to SEQ ID NO:33, or the complement thereof. In some embodiments, the isolated cDNA molecules comprise or consist of a nucleotide sequence that has at least about 96% sequence identity to SEQ ID NO:48, and lacks an AAAG tetranucleotide at positions corresponding to positions 741-744 according to SEQ ID NO:33, or the complement thereof. In some embodiments, the isolated cDNA molecules comprise or consist of a nucleotide sequence that has at least about 98% sequence identity to SEQ ID NO:48, and lacks an AAAG tetranucleotide at positions corresponding to positions 741-744 according to SEQ ID NO:33, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:53, and lacks an AAAG tetranucleotide at positions corresponding to positions 980-983 according to SEQ ID NO:34, or the complement thereof. In some embodiments, the isolated cDNA molecules comprise or consist of a nucleotide sequence that has at least about 90% sequence identity to SEQ ID NO:53, and lacks an AAAG tetranucleotide at positions corresponding to positions 980-983 according to SEQ ID NO:34, or the complement thereof. In some embodiments, the isolated cDNA molecules comprise or consist of a nucleotide sequence that has at least about 92% sequence identity to SEQ ID NO:53, and lacks an AAAG tetranucleotide at positions corresponding to positions 980-983 according to SEQ ID NO:34, or the complement thereof. In some embodiments, the isolated cDNA molecules comprise or consist of a nucleotide sequence that has at least about 94% sequence identity to SEQ ID NO:53, and lacks an AAAG tetranucleotide at positions corresponding to positions 980-983 according to SEQ ID NO:34, or the complement thereof. In some embodiments, the isolated cDNA molecules comprise or consist of a nucleotide sequence that has at least about 96% sequence identity to SEQ ID NO:53, and lacks an AAAG tetranucleotide at positions corresponding to positions 980-983 according to SEQ ID NO:34, or the complement thereof. In some embodiments, the isolated cDNA molecules comprise or consist of a nucleotide sequence that has at least about 98% sequence identity to SEQ ID NO:53, and lacks an AAAG tetranucleotide at positions corresponding to positions 980-983 according to SEQ ID NO:34, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:39, and comprises an insertion of a thymine at a position corresponding to position 1,410 according to SEQ ID NO:39, or the complement thereof. In some embodiments, the isolated cDNA molecules comprise or consist of a nucleotide sequence that has at least about 90% sequence identity to SEQ ID NO:39, and comprises an insertion of a thymine at a position corresponding to position 1,410 according to SEQ ID NO:39, or the complement thereof. In some embodiments, the isolated cDNA molecules comprise or consist of a nucleotide sequence that has at least about 92% sequence identity to SEQ ID NO:39, and comprises an insertion of a thymine at a position corresponding to position 1,410 according to SEQ ID NO:39, or the complement thereof. In some embodiments, the isolated cDNA molecules comprise or consist of a nucleotide sequence that has at least about 94% sequence identity to SEQ ID NO:39, and comprises an insertion of a thymine at a position corresponding to position 1,410 according to SEQ ID NO:39, or the complement thereof. In some embodiments, the isolated cDNA molecules comprise or consist of a nucleotide sequence that has at least about 96% sequence identity to SEQ ID NO:39, and comprises an insertion of a thymine at a position corresponding to position 1,410 according to SEQ ID NO:39, or the complement thereof. In some embodiments, the isolated cDNA molecules comprise or consist of a nucleotide sequence that has at least about 98% sequence identity to SEQ ID NO:39, and comprises an insertion of a thymine at a position corresponding to position 1,410 according to SEQ ID NO:39, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:44, and comprises an insertion of a thymine at a position corresponding to position 1,311 according to SEQ ID NO:44, or the complement thereof. In some embodiments, the isolated cDNA molecules comprise or consist of a nucleotide sequence that has at least about 90% sequence identity to SEQ ID NO:44, and comprises an insertion of a thymine at a position corresponding to position 1,311 according to SEQ ID NO:44, or the complement thereof. In some embodiments, the isolated cDNA molecules comprise or consist of a nucleotide sequence that has at least about 92% sequence identity to SEQ ID NO:44, and comprises an insertion of a thymine at a position corresponding to position 1,311 according to SEQ ID NO:44, or the complement thereof. In some embodiments, the isolated cDNA molecules comprise or consist of a nucleotide sequence that has at least about 94% sequence identity to SEQ ID NO:44, and comprises an insertion of a thymine at a position corresponding to position 1,311 according to SEQ ID NO:44, or the complement thereof. In some embodiments, the isolated cDNA molecules comprise or consist of a nucleotide sequence that has at least about 96% sequence identity to SEQ ID NO:44, and comprises an insertion of a thymine at a position corresponding to position 1,311 according to SEQ ID NO:44, or the complement thereof. In some embodiments, the isolated cDNA molecules comprise or consist of a nucleotide sequence that has at least about 98% sequence identity to SEQ ID NO:44, and comprises an insertion of a thymine at a position corresponding to position 1,311 according to SEQ ID NO:44, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:49, and comprises an insertion of a thymine at a position corresponding to position 1,232 according to SEQ ID NO:49, or the complement thereof. In some embodiments, the isolated cDNA molecules comprise or consist of a nucleotide sequence that has at least about 90% sequence identity to SEQ ID NO:49, and comprises an insertion of a thymine at a position corresponding to position 1,232 according to SEQ ID NO:49, or the complement thereof. In some embodiments, the isolated cDNA molecules comprise or consist of a nucleotide sequence that has at least about 92% sequence identity to SEQ ID NO:49, and comprises an insertion of a thymine at a position corresponding to position 1,232 according to SEQ ID NO:49, or the complement thereof. In some embodiments, the isolated cDNA molecules comprise or consist of a nucleotide sequence that has at least about 94% sequence identity to SEQ ID NO:49, and comprises an insertion of a thymine at a position corresponding to position 1,232 according to SEQ ID NO:49, or the complement thereof. In some embodiments, the isolated cDNA molecules comprise or consist of a nucleotide sequence that has at least about 96% sequence identity to SEQ ID NO:49, and comprises an insertion of a thymine at a position corresponding to position 1,232 according to SEQ ID NO:49, or the complement thereof. In some embodiments, the isolated cDNA molecules comprise or consist of a nucleotide sequence that has at least about 98% sequence identity to SEQ ID NO:49, and comprises an insertion of a thymine at a position corresponding to position 1,232 according to SEQ ID NO:49, or the complement thereof.

In some embodiments, the isolated cDNA molecules comprise or consist of a nucleotide sequence that has at least about 90%, at least about 91%, at least about 92%, at least about 93%, at least about 94%, at least about 95%, at least about 96%, at least about 97%, at least about 98%, or at least about 99% sequence identity to SEQ ID NO:54, and comprises or an insertion of a thymine at a position corresponding to position 1,471 according to SEQ ID NO:54, or the complement thereof. In some embodiments, the isolated cDNA molecules comprise or consist of a nucleotide sequence that has at least about 90% sequence identity to SEQ ID NO:54, and comprises or an insertion of a thymine at a position corresponding to position 1,471 according to SEQ ID NO:54, or the complement thereof. In some embodiments, the isolated cDNA molecules comprise or consist of a nucleotide sequence that has at least about 92% sequence identity to SEQ ID NO:54, and comprises or an insertion of a thymine at a position corresponding to position 1,471 according to SEQ ID NO:54, or the complement thereof. In some embodiments, the isolated cDNA molecules comprise or consist of a nucleotide sequence that has at least about 94% sequence identity to SEQ ID NO:54, and comprises or an insertion of a thymine at a position corresponding to position 1,471 according to SEQ ID NO:54, or the complement thereof. In some embodiments, the isolated cDNA molecules comprise or consist of a nucleotide sequence that has at least about 96% sequence identity to SEQ ID NO:54, and comprises or an insertion of a thymine at a position corresponding to position 1,471 according to SEQ ID NO:54, or the complement thereof. In some embodiments, the isolated cDNA molecules comprise or consist of a nucleotide sequence that has at least about 98% sequence identity to SEQ ID NO:54, and comprises or an insertion of a thymine at a position corresponding to position 1,471 according to SEQ ID NO:54, or the complement thereof.

Herein, if reference is made to percent sequence identity, the higher percentages of sequence identity are preferred over the lower ones.

In some embodiments, the isolated cDNA molecules comprise SEQ ID NO:35. In some embodiments, the isolated cDNA molecules consist of SEQ ID NO:35. In some embodiments, the isolated cDNA molecules comprise SEQ ID NO:40. In some embodiments, the isolated cDNA molecules consist of SEQ ID NO:40. In some embodiments, the isolated cDNA molecules comprise SEQ ID NO:45. In some embodiments, the isolated cDNA molecules consist of SEQ ID NO:45. In some embodiments, the isolated cDNA molecules comprise SEQ ID NO:50. In some embodiments, the isolated cDNA molecules consist of SEQ ID NO:50.

In some embodiments, the isolated cDNA molecules comprise SEQ ID NO:38. In some embodiments, the isolated cDNA molecules consist of SEQ ID NO:38. In some embodiments, the isolated cDNA molecules comprise SEQ ID NO:43. In some embodiments, the isolated cDNA molecules consist of SEQ ID NO:43. In some embodiments, the isolated cDNA molecules comprise SEQ ID NO:48. In some embodiments, the isolated cDNA molecules consist of SEQ ID NO:48. In some embodiments, the isolated cDNA molecules comprise SEQ ID NO:53. In some embodiments, the isolated cDNA molecules consist of SEQ ID NO:53.

In some embodiments, the isolated cDNA molecules comprise SEQ ID NO:39. In some embodiments, the isolated cDNA molecules consist of SEQ ID NO:39. In some embodiments, the isolated cDNA molecules comprise SEQ ID NO:44. In some embodiments, the isolated cDNA molecules consist of SEQ ID NO:44. In some embodiments, the isolated cDNA molecules comprise SEQ ID NO:49. In some embodiments, the isolated cDNA molecules consist of SEQ ID NO:49. In some embodiments, the isolated cDNA molecules comprise SEQ ID NO:54. In some embodiments, the isolated cDNA molecules consist of SEQ ID NO:54.

In some embodiments, the isolated mRNA molecules or cDNA molecules comprise less than the entire mRNA or cDNA sequence. In some embodiments, the isolated mRNA molecules or cDNA molecules comprise or consist of at least about 5, at least about 8, at least about 10, at least about 12, at least about 15, at least about 20, at least about 25, at least about 30, at least about 35, at least about 40, at least about 45, at least about 50, at least about 60, at least about 70, at least about 80, at least about 90, at least about 100, at least about 200, at least about 300, at least about 400, at least about 500, at least about 600, at least about 700, at least about 800, at least about 900, at least about 1000, at least about 1100, at least about 1200, at least about 1300, at least about 1400, at least about 1500, at least about 1600, at least about 1700, at least about 1800, at least about 1900, or at least about 2000 contiguous nucleotides of any of the GPR75 mRNA molecules or cDNA molecules disclosed herein. In some embodiments, the isolated mRNA molecules or cDNA molecules comprise or consist of at least about 400 to at least about 500 contiguous nucleotides of any of the GPR75 mRNA molecules or cDNA molecules disclosed herein. In some embodiments, the isolated cDNA molecules comprise or consist of at least about 1000 to at least about 2000 contiguous nucleotides of any of the GPR75 mRNA molecules or cDNA molecules disclosed herein.

In some embodiments, these isolated mRNA molecules comprise a UAUCCCG heptanucleotide at the position corresponding to positions 539-545 according to SEQ ID NO:11, a UAUCCCG heptanucleotide at the position corresponding to positions 440-446 according to SEQ ID NO:16, a UAUCCCG heptanucleotide at the position corresponding to positions 361-367 according to SEQ ID NO:21, or a UAUCCCG heptanucleotide at the position corresponding to positions 600-606 according to SEQ ID NO:26. In some embodiments, these isolated mRNA molecules comprise an adenine at the position corresponding to position 556 according to SEQ ID NO:12, an adenine at the position corresponding to position 457 according to SEQ ID NO:17, an adenine at the position corresponding to position 378 according to SEQ ID NO:22, or an adenine at the position corresponding to position 617 according to SEQ ID NO:27. In some embodiments, these isolated mRNA molecules comprise a uracil at the position corresponding to position 910 according to SEQ ID NO:13, a uracil at the position corresponding to position 811 according to SEQ ID NO:18, a uracil at the position corresponding to position 732 according to SEQ ID NO:23, or a uracil at the position corresponding to position 971 according to SEQ ID NO:28. In some embodiments, these isolated mRNA molecules comprise an AGCC tetranucleotide at the position corresponding to positions 919-922 according to SEQ ID NO:14, an AGCC tetranucleotide at the position corresponding to positions 820-823 according to SEQ ID NO:19, an AGCC tetranucleotide at the position corresponding to positions 741-744 according to SEQ ID NO:24, or an AGCC tetranucleotide at the position corresponding to positions 980-983 according to SEQ ID NO:29. In some embodiments, these isolated mRNA molecules comprise an insertion of a uracil at the position corresponding to position 1,410 according to SEQ ID NO:15, an insertion of a uracil at the position corresponding to position 1,311 according to SEQ ID NO:20, an insertion of a uracil at the position corresponding to position 1,232 according to SEQ ID NO:25, or an insertion of a uracil at the position corresponding to position 1,471 according to SEQ ID NO:30. In some embodiments, these isolated mRNA molecules comprise a guanine at the position corresponding to position 830 according to SEQ ID NO:100, a guanine at the position corresponding to position 731 according to SEQ ID NO:101, a guanine at the position corresponding to position 652 according to SEQ ID NO:102, or a guanine at the position corresponding to position 891 according to SEQ ID NO:103.

In some embodiments, these isolated cDNA molecules comprise a TATCCCG heptanucleotide at the position corresponding to positions 539-545 according to SEQ ID NO:35, a TATCCCG heptanucleotide at the position corresponding to positions 440-446 according to SEQ ID NO:40, a TATCCCG heptanucleotide at the position corresponding to positions 361-367 according to SEQ ID NO:45, or a TATCCCG heptanucleotide at the position corresponding to positions 600-606 according to SEQ ID NO:50. In some embodiments, these isolated cDNA molecules comprise an adenine at the position corresponding to position 556 according to SEQ ID NO:36, an adenine at the position corresponding to position 457 according to SEQ ID NO:41, an adenine at the position corresponding to position 378 according to SEQ ID NO:46, or an adenine at the position corresponding to position 617 according to SEQ ID NO:51. In some embodiments, these isolated cDNA molecules comprise a thymine at the position corresponding to position 910 according to SEQ ID NO:37, a thymine at the position corresponding to position 811 according to SEQ ID NO:42, a thymine at the position corresponding to position 732 according to SEQ ID NO:47, or a thymine at the position corresponding to position 971 according to SEQ ID NO:52. In some embodiments, these isolated cDNA molecules comprise an AGCC tetranucleotide at the position corresponding to positions 919-922 according to SEQ ID NO:38, an AGCC tetranucleotide at the position corresponding to positions 820-823 according to SEQ ID NO:43, an AGCC tetranucleotide at the position corresponding to positions 741-744 according to SEQ ID NO:48, or an AGCC tetranucleotide at the position corresponding to positions 980-983 according to SEQ ID NO:53. In some embodiments, these isolated cDNA molecules comprise an insertion of a thymine at the position corresponding to position 1,410 according to SEQ ID NO:39, an insertion of a thymine at the position corresponding to position 1,311 according to SEQ ID NO:44, an insertion of a thymine at the position corresponding to position 1,232 according to SEQ ID NO:49, or an insertion of a thymine at the position corresponding to position 1,471 according to SEQ ID NO:54. In some embodiments, these isolated cDNA molecules comprise a guanine at the position corresponding to position 830 according to SEQ ID NO:104, a guanine at the position corresponding to position 731 according to SEQ ID NO:105, a guanine at the position corresponding to position 652 according to SEQ ID NO:106, or a guanine at the position corresponding to position 891 according to SEQ ID NO:107.

The genomic nucleic acid molecules, mRNA molecules, and cDNA molecules can be from any organism. For example, the genomic nucleic acid molecules, mRNA molecules, and cDNA molecules can be human or an ortholog from another organism, such as a non-human mammal, a rodent, a mouse, or a rat. It is understood that gene sequences within a population can vary due to polymorphisms such as single-nucleotide polymorphisms. The examples provided herein are only exemplary sequences. Other sequences are also possible.

The present disclosure also provides fragments of any of the isolated genomic nucleic acid molecules, mRNA molecules, or cDNA molecules disclosed herein. In some embodiments, the fragments comprise or consist of at least about 5, at least about 8, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 30, at least about 35, at least about 40, at least about 45, at least about 50, at least about 55, at least about 60, at least about 65, at least about 70, at least about 75, at least about 80, at least about 85, at least about 90, at least about 95, or at least about 100 contiguous residues of any of the nucleic acid molecules disclosed herein, or any complement thereof. In some embodiments, the fragments comprise or consist of at least about 20, at least about 25, at least about 30, or at least about 35 contiguous residues of any of the nucleic acid molecules disclosed herein, or any complement thereof. In this regard, the longer fragments are preferred over the shorter ones. Such fragments may be used, for example, as probes, primers, alteration-specific probes, or alteration-specific primers as described or exemplified herein, and include, without limitation primers, probes, antisense RNAs, shRNAs, and siRNAs, each of which is described in more detail elsewhere herein.

Also provided herein are functional polynucleotides that can interact with the disclosed nucleic acid molecules. Examples of functional polynucleotides include, but are not limited to, antisense molecules, aptamers, ribozymes, triplex forming molecules, and external guide sequences. The functional polynucleotides can act as effectors, inhibitors, modulators, and stimulators of a specific activity possessed by a target molecule, or the functional polynucleotides can possess a de novo activity independent of any other molecules.

The isolated nucleic acid molecules disclosed herein can comprise RNA, DNA, or both RNA and DNA. The isolated nucleic acid molecules can also be linked or fused to a heterologous nucleic acid sequence, such as in a vector, or a heterologous label. For example, the isolated nucleic acid molecules disclosed herein can be within a vector or as an exogenous donor sequence comprising the isolated nucleic acid molecule and a heterologous nucleic acid sequence. The isolated nucleic acid molecules can also be linked or fused to a heterologous label. The label can be directly detectable (such as, for example, fluorophore) or indirectly detectable (such as, for example, hapten, enzyme, or fluorophore quencher). Such labels can be detectable by spectroscopic, photochemical, biochemical, immunochemical, or chemical means. Such labels include, for example, radiolabels, pigments, dyes, chromogens, spin labels, and fluorescent labels. The label can also be, for example, a chemiluminescent substance; a metal-containing substance; or an enzyme, where there occurs an enzyme-dependent secondary generation of signal. The term "label" can also refer to a "tag" or hapten that can bind selectively to a conjugated molecule such that the conjugated molecule, when added subsequently along with a substrate, is used to generate a detectable signal. For example, biotin can be used as a tag along with an avidin or streptavidin conjugate of horseradish peroxidate (HRP) to bind to the tag, and examined using a calorimetric substrate (such as, for example, tetramethylbenzidine (TMB)) or a fluorogenic substrate to detect the presence of HRP. Exemplary labels that can be used as tags to facilitate purification include, but are not limited to, myc, HA, FLAG or 3×FLAG, 6×His or polyhistidine, glutathione-S-transferase (GST), maltose binding protein, an epitope tag, or the Fc portion of immunoglobulin. Numerous labels include, for example, particles, fluorophores, haptens, enzymes and their calorimetric, fluorogenic and chemiluminescent substrates and other labels.

The disclosed nucleic acid molecules can comprise, for example, nucleotides or non-natural or modified nucleotides, such as nucleotide analogs or nucleotide substitutes. Such nucleotides include a nucleotide that contains a modified base, sugar, or phosphate group, or that incorporates a non-natural moiety in its structure. Examples of non-natural nucleotides include, but are not limited to, dideoxynucleotides, biotinylated, aminated, deaminated, alkylated, benzylated, and fluorophor-labeled nucleotides.

The nucleic acid molecules disclosed herein can also comprise one or more nucleotide analogs or substitutions. A nucleotide analog is a nucleotide which contains a modification to either the base, sugar, or phosphate moieties. Modifications to the base moiety include, but are not limited to, natural and synthetic modifications of A, C, G, and T/U, as well as different purine or pyrimidine bases such as, for example, pseudouridine, uracil-5-yl, hypoxanthin-9-yl (I), and 2-aminoadenin-9-yl. Modified bases include, but are not limited to, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo (such as, for example, 5-bromo), 5-trifluoromethyl and other 5-substituted uracils and cytosines, 7-methylguanine, 7-methyladenine, 8-azaguanine, 8-azaadenine, 7-deazaguanine, 7-deazaadenine, 3-deazaguanine, and 3-deazaadenine.

Nucleotide analogs can also include modifications of the sugar moiety. Modifications to the sugar moiety include, but are not limited to, natural modifications of the ribose and deoxy ribose as well as synthetic modifications. Sugar modifications include, but are not limited to, the following modifications at the 2' position: OH; F; O-, S-, or N-alkyl; O-, S-, or N-alkenyl; O-, S- or N-alkynyl; or O-alkyl-O-alkyl, wherein the alkyl, alkenyl, and alkynyl may be substituted or unsubstituted $C_{1-10}$alkyl or $C_{2-10}$alkenyl, and $C_{2-10}$alkynyl. Exemplary 2' sugar modifications also include, but are not limited to, —O[(CH$_2$)$_n$O]$_m$CH$_3$, —O(CH$_2$)$_n$OCH$_3$, —O(CH$_2$)$_n$NH$_2$, —O(CH$_2$)$_n$CH$_3$, —O(CH$_2$)$_n$—ONH$_2$, and —O(CH$_2$)$_n$ON[(CH$_2$)$_n$CH$_3$)]$_2$, where n and m, independently, are from 1 to about 10. Other modifications at the 2' position include, but are not limited to, $C_{1-10}$alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as CH$_2$ and S. Nucleotide sugar analogs can also have sugar mimetics, such as cyclobutyl moieties in place of the pentofuranosyl sugar.

Nucleotide analogs can also be modified at the phosphate moiety. Modified phosphate moieties include, but are not limited to, those that can be modified so that the linkage between two nucleotides contains a phosphorothioate, chiral phosphorothioate, phosphorodithioate, phosphotriester, aminoalkylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts, and free acid forms are also included. Nucleotide substitutes also include peptide nucleic acids (PNAs).

The present disclosure also provides vectors comprising any one or more of the nucleic acid molecules disclosed herein. In some embodiments, the vectors comprise any one or more of the nucleic acid molecules disclosed herein and a heterologous nucleic acid. The vectors can be viral or nonviral vectors capable of transporting a nucleic acid molecule. In some embodiments, the vector is a plasmid or cosmid (such as, for example, a circular double-stranded DNA into which additional DNA segments can be ligated). In some embodiments, the vector is a viral vector, wherein additional DNA segments can be ligated into the viral genome. Expression vectors include, but are not limited to, plasmids, cosmids, retroviruses, adenoviruses, adeno-associated viruses (AAV), plant viruses such as cauliflower mosaic virus and tobacco mosaic virus, yeast artificial chromosomes (YACs), Epstein-Barr (EBV)-derived episomes, and other expression vectors known in the art.

Desired regulatory sequences for mammalian host cell expression can include, for example, viral elements that direct high levels of polypeptide expression in mammalian cells, such as promoters and/or enhancers derived from retroviral LTRs, cytomegalovirus (CMV) (such as, for example, CMV promoter/enhancer), Simian Virus 40 (SV40) (such as, for example, SV40 promoter/enhancer), adenovirus, (such as, for example, the adenovirus major late promoter (AdMLP)), polyoma and strong mammalian promoters such as native immunoglobulin and actin promoters. Methods of expressing polypeptides in bacterial cells or fungal cells (such as, for example, yeast cells) are also well known. A promoter can be, for example, a constitutively active promoter, a conditional promoter, an inducible promoter, a temporally restricted promoter (such as, for example, a developmentally regulated promoter), or a spatially restricted promoter (such as, for example, a cell-specific or tissue-specific promoter).

Percent identity (or percent complementarity) between particular stretches of nucleotide sequences within nucleic acid molecules or amino acid sequences within polypeptides can be determined routinely using BLAST programs (basic local alignment search tools) and PowerBLAST programs (Altschul et al., J. Mol. Biol., 1990, 215, 403-410; Zhang and Madden, Genome Res., 1997, 7, 649-656) or by using the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489). Herein, if reference is made to percent sequence identity, the higher percentages of sequence identity are preferred over the lower ones.

The present disclosure also provides compositions comprising any one or more of the isolated nucleic acid molecules, genomic nucleic acid molecules, mRNA molecules, and/or cDNA molecules disclosed herein. In some embodiments, the composition is a pharmaceutical composition. In some embodiments, the compositions comprise a carrier and/or excipient. Examples of carriers include, but are not limited to, poly(lactic acid) (PLA) microspheres, poly(D,L-lactic-coglycolic-acid) (PLGA) microspheres, liposomes, micelles, inverse micelles, lipid cochleates, and lipid microtubules. A carrier may comprise a buffered salt solution such as PBS, HBSS, etc.

As used herein, the phrase "corresponding to" or grammatical variations thereof when used in the context of the numbering of a particular nucleotide or nucleotide sequence or position refers to the numbering of a specified reference sequence when the particular nucleotide or nucleotide sequence is compared to a reference sequence (such as, for example, SEQ ID NO:1, SEQ ID NO:7, or SEQ ID NO:31). In other words, the residue (such as, for example, nucleotide or amino acid) number or residue (such as, for example, nucleotide or amino acid) position of a particular polymer is designated with respect to the reference sequence rather than by the actual numerical position of the residue within the particular nucleotide or nucleotide sequence. For example, a particular nucleotide sequence can be aligned to a reference sequence by introducing gaps to optimize residue matches between the two sequences. In these cases, although the gaps are present, the numbering of the residue in the particular nucleotide or nucleotide sequence is made with respect to the reference sequence to which it has been aligned.

For example, a nucleic acid molecule comprising a nucleotide sequence encoding a human GPR75 polypeptide, wherein the nucleotide sequence lacks a CCAGTAG heptanucleotide at positions corresponding to positions 5,540-5,546 according to SEQ ID NO:1 means that if the nucleotide sequence of the GPR75 genomic nucleic acid molecule is aligned to the sequence of SEQ ID NO:1, the GPR75 sequence has a deletion of a CCAGTAG heptanucleotide residue at the position that corresponds to positions 5,540-5,546 of SEQ ID NO:1. The same applies for mRNA molecules comprising a nucleotide sequence encoding a human GPR75 polypeptide, wherein the nucleotide sequence lacks a CCAGUAG heptanucleotide at positions corresponding to positions 539-545 according to SEQ ID NO:7, and cDNA molecules comprising a nucleotide sequence encoding a human GPR75 polypeptide, wherein the nucleotide sequence lacks a CCAGTAG heptanucleotide at positions corresponding to positions 539-545 according to SEQ ID NO:31. In other words, these phrases refer to a nucleic acid molecule encoding a GPR75 polypeptide, wherein the genomic nucleic acid molecule has a nucleotide sequence that lacks a CCAGTAG heptanucleotide according to SEQ ID NO:1 and, thus, comprises nucleotides that are homologous to the TATCCCG nucleotides at positions 5,540-5,546 of SEQ ID NO:2 (or wherein the mRNA molecule has a nucleotide sequence that lacks a CCAGUAG heptanucleotide according to SEQ ID NO:7 and, thus, comprises nucleotides that are homologous to the UAUCCCG heptanucleotide residue at positions 539-545 of SEQ ID NO:11, or wherein the cDNA molecule has a nucleotide sequence that lacks a CCAGTAG heptanucleotide according to SEQ ID NO:31 and, thus, comprises residues that are homologous to the TATCCCG residues at positions 539-545 of SEQ ID NO:35). Herein, such a sequence is also referred to as "GPR75 sequence with the Ala110fs alteration" or "GPR75 sequence with the Ala110fs variation" referring to genomic nucleic acid molecules. The same can be carried out for all other molecules disclosed herein.

As described herein, a position within a GPR75 genomic nucleic acid molecule that corresponds to positions 5,540-5,546 according to SEQ ID NO:2, for example, can be identified by performing a sequence alignment between the nucleotide sequence of a particular GPR75 nucleic acid molecule and the nucleotide sequence of SEQ ID NO:2. A variety of computational algorithms exist that can be used for performing a sequence alignment to identify a nucleotide position that corresponds to, for example, positions 5,540-5,546 in SEQ ID NO:2. For example, by using the NCBI BLAST algorithm (Altschul et al., Nucleic Acids Res., 1997, 25, 3389-3402) or CLUSTALW software (Sievers and Higgins, Methods Mol. Biol., 2014, 1079, 105-116) sequence alignments may be performed. However, sequences can also be aligned manually.

The amino acid sequence of a GPR75 reference polypeptide is set forth in SEQ ID NO:55. Referring to SEQ ID NO:55, the GPR75 reference polypeptide is 540 amino acids in length. Referring to SEQ ID NO:55, position 110 is alanine. Referring to SEQ ID NO:55, position 116 is alanine. Referring to SEQ ID NO:55, position 207 is tyrosine. Referring to SEQ ID NO:55, position 234 is glutamine. Referring to SEQ ID NO:55, position 236 is arginine. Referring to SEQ ID NO:55, position 400 is cysteine.

A GPR75 variant polypeptide exists (SEQ ID NO:56; Ala110fs), wherein the alanine at position 110 (referring to SEQ ID NO:55) is altered due to a frameshift mutation in the underlying mRNA molecule, resulting in a truncated 130 amino acid polypeptide. Referring to SEQ ID NO:56, the nucleotides at positions 110-130 are different than the corresponding nucleotides at the same positions of SEQ ID NO:55.

Another GPR75 variant polypeptide exists (SEQ ID NO:57; Ala116Thr), wherein the alanine at position 116 (referring to SEQ ID NO:55) is replaced with a threonine, resulting in a 540 amino acid polypeptide.

Another GPR75 variant polypeptide exists (SEQ ID NO:58; Gln234Stop), wherein the glutamine at position 234 (referring to SEQ ID NO:55) is altered due to a mutation in the underlying mRNA molecule introducing a Stop codon at amino acid position 234, resulting in a truncated 233 amino acid polypeptide.

Another GPR75 variant polypeptide exists (SEQ ID NO:59; Arg236fs), wherein the arginine at position 236 (referring to SEQ ID NO:55) is altered due to a frameshift mutation in the underlying mRNA molecule, resulting in a truncated 239 amino acid polypeptide. Referring to SEQ ID NO:59, the nucleotides at positions 236-239 are different than the corresponding nucleotides at the same positions of SEQ ID NO:55.

Another GPR75 variant polypeptide exists (SEQ ID NO:60; Cys400fs), wherein the cysteine at position 400 (referring to SEQ ID NO:55) is altered due to a frameshift mutation in the underlying mRNA molecule, resulting in a truncated 425 amino acid polypeptide. Referring to SEQ ID NO:60, the nucleotides at positions 400-425 are different than the corresponding nucleotides at the same positions of SEQ ID NO:55.

Another GPR75 variant polypeptide exists (SEQ ID NO:108; Tyr207Cys), wherein the tyrosine at position 207 (referring to SEQ ID NO:55) is replaced with a cysteine, resulting in a 540 amino acid polypeptide.

The present disclosure also provides isolated human GPR75 polypeptides having an amino acid sequence at least about 90%, at least about 91%, at least about 92%, at least about 93%, at least about 94%, at least about 95%, at least about 96%, at least about 97%, at least about 98%, or at least about 99% identical to SEQ ID NO:56, and comprising nucleotides at positions corresponding to positions 110-130 according to SEQ ID NO:56. In some embodiments, the isolated human GPR75 polypeptides have an amino acid sequence at least about 90% identical to SEQ ID NO:56, and comprising nucleotides at positions corresponding to positions 110-130 according to SEQ ID NO:56. In some embodiments, the isolated human GPR75 polypeptides have an amino acid sequence at least about 92% identical to SEQ ID NO:56, and comprising nucleotides at positions corresponding to positions 110-130 according to SEQ ID NO:56. In some embodiments, the isolated human GPR75 polypeptides have an amino acid sequence at least about 94% identical to SEQ ID NO:56, and comprising nucleotides at positions corresponding to positions 110-130 according to SEQ ID NO:56. In some embodiments, the isolated human GPR75 polypeptides have an amino acid sequence at least about 96% identical to SEQ ID NO:56, and comprising nucleotides at positions corresponding to positions 110-130 according to SEQ ID NO:56. In some embodiments, the isolated human GPR75 polypeptides have an amino acid sequence at least about 98% identical to SEQ ID NO:56, and comprising nucleotides at positions corresponding to positions 110-130 according to SEQ ID NO:56. In some embodiments, these GPR75 polypeptides lack amino acids at positions corresponding to positions 110-540 according to SEQ ID NO:55.

The present disclosure also provides isolated human GPR75 polypeptides having an amino acid sequence at least about 90%, at least about 91%, at least about 92%, at least about 93%, at least about 94%, at least about 95%, at least about 96%, at least about 97%, at least about 98%, or at least about 99% identical to SEQ ID NO:59, and comprising nucleotides at positions corresponding to positions 236-239 according to SEQ ID NO:59. In some embodiments, the isolated human GPR75 polypeptides have an amino acid sequence at least about 90% identical to SEQ ID NO:59, and comprising nucleotides at positions corresponding to positions 236-239 according to SEQ ID NO:59. In some embodiments, the isolated human GPR75 polypeptides have an amino acid sequence at least about 92% identical to SEQ ID NO:59, and comprising nucleotides at positions corresponding to positions 236-239 according to SEQ ID NO:59. In some embodiments, the isolated human GPR75 polypeptides have an amino acid sequence at least about 94% identical to SEQ ID NO:59, and comprising nucleotides at positions corresponding to positions 236-239 according to SEQ ID NO:59. In some embodiments, the isolated human GPR75 polypeptides have an amino acid sequence at least about 96% identical to SEQ ID NO:59, and comprising nucleotides at positions corresponding to positions 236-239 according to SEQ ID NO:59. In some embodiments, the isolated human GPR75 polypeptides have an amino acid sequence at least about 98% identical to SEQ ID NO:59, and comprising nucleotides at positions corresponding to positions 236-239 according to SEQ ID NO:59. In some embodiments, these GPR75 polypeptides lack amino acids at positions corresponding to positions 236-540 according to SEQ ID NO:55.

The present disclosure also provides isolated human GPR75 polypeptides having an amino acid sequence at least about 90%, at least about 91%, at least about 92%, at least about 93%, at least about 94%, at least about 95%, at least about 96%, at least about 97%, at least about 98%, or at least about 99% identical to SEQ ID NO:60, and comprising nucleotides at positions corresponding to positions 400-425 according to SEQ ID NO:60. In some embodiments, the isolated human GPR75 polypeptides have an amino acid sequence at least about 90% identical to SEQ ID NO:60, and comprising nucleotides at positions corresponding to positions 400-425 according to SEQ ID NO:60. In some embodiments, the isolated human GPR75 polypeptides have an amino acid sequence at least about 92% identical to SEQ ID NO:60, and comprising nucleotides at positions corresponding to positions 400-425 according to SEQ ID NO:60. In some embodiments, the isolated human GPR75 polypeptides have an amino acid sequence at least about 94% identical to SEQ ID NO:60, and comprising nucleotides at positions corresponding to positions 400-425 according to SEQ ID NO:60. In some embodiments, the isolated human GPR75 polypeptides have an amino acid sequence at least about 96% identical to SEQ ID NO:60, and comprising nucleotides at positions corresponding to positions 400-425 according to SEQ ID NO:60. In some embodiments, the isolated human GPR75 polypeptides have an amino acid sequence at least about 98% identical to SEQ ID NO:60, and comprising nucleotides at positions corresponding to positions 400-425 according to SEQ ID NO:60. In some embodiments, these GPR75 polypeptides lack amino acids at positions corresponding to positions 400-540 according to SEQ ID NO:55.

In some embodiments, the amino acid sequence of the isolated human GPR75 polypeptide comprises or consists of SEQ ID NO:56. In some embodiments, the amino acid sequence of the isolated human GPR75 polypeptide comprises SEQ ID NO:56. In some embodiments, the amino acid sequence of the isolated human GPR75 polypeptide consists of SEQ ID NO:56.

In some embodiments, the amino acid sequence of the isolated human GPR75 polypeptide comprises or consists of SEQ ID NO:59. In some embodiments, the amino acid sequence of the isolated human GPR75 polypeptide comprises SEQ ID NO:59. In some embodiments, the amino acid sequence of the isolated human GPR75 polypeptide consists of SEQ ID NO:59.

In some embodiments, the amino acid sequence of the isolated human GPR75 polypeptide comprises or consists of SEQ ID NO:60. In some embodiments, the amino acid sequence of the isolated human GPR75 polypeptide comprises SEQ ID NO:60. In some embodiments, the amino acid sequence of the isolated human GPR75 polypeptide consists of SEQ ID NO:60.

In some embodiments, the isolated polypeptides comprise or consist of an amino acid sequence at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, or 100% identical to at least about 8, at least about 10, at least about 15, at least about 20, at least about 25, at least about 30, at least about 35, at least about 40, at least about 45, at least about 50, at least about 60, at least about 70, at least about 80, at least about 90, at least about 100, at least about 150, at least about 200, at least about 250, at least about 300, at least about 350, at least about 400, at least about 450, at least about 500, at least about 550, or at least about 600 contiguous amino acids of any of the GPR75 polypeptides disclosed herein. In some embodiments, the isolated polypeptides comprise or consist of an amino acid sequence at least about 90%, at least about 91%, at least about 92%, at least about 93%, at least about 94%, at least about 95%, at least about 96%, at least about 97%, at least about 98%, at least about 99%, or 100% identical to at least about 8, at least about 10, at least about 15, at least about 20, at least about 25, at least about 30, at least about 35, at least about 40, at least about 45, at least about 50, at least about 60, at least about 70, at least about 80, at least about 90, at least about 100, at least about 150, at least about 200, at least about 250, at least about 300, at least about 350, at least about 400, at least about 450, at least about 500, at least about 550, or at least about 600 contiguous amino acids of any of the GPR75 polypeptides disclosed herein.

The isolated polypeptides disclosed herein can comprise an amino acid sequence of a naturally occurring GPR75 polypeptide, or can comprise a non-naturally occurring sequence. In some embodiments, the naturally occurring sequence can differ from the non-naturally occurring sequence due to conservative amino acid substitutions. For example, the sequence can be identical with the exception of conservative amino acid substitutions.

In some embodiments, the isolated polypeptides comprise non-natural or modified amino acids or peptide analogs. For example, there are numerous D-amino acids or amino acids which have a different functional substituent than the naturally occurring amino acids.

The present disclosure also provides nucleic acid molecules encoding any of the polypeptides disclosed herein. This includes all degenerate sequences related to a specific polypeptide sequence (i.e., all nucleic acids having a sequence that encodes one particular polypeptide sequence as well as all nucleic acids, including degenerate nucleic acids, encoding the disclosed variants and derivatives of the protein sequences). Thus, while each particular nucleic acid sequence may not be written out herein, each and every sequence is in fact disclosed and described herein through the disclosed polypeptide sequences.

The present disclosure also provides compositions comprising any one or more of the nucleic acid molecules and/or any one or more of the polypeptides disclosed herein. In some embodiments, the compositions comprise a carrier. Examples of carriers include, but are not limited to, poly (lactic acid) (PLA) microspheres, poly(D,L-lactic-coglycolic-acid) (PLGA) microspheres, liposomes, micelles, inverse micelles, lipid cochleates, and lipid microtubules.

The present disclosure also provides methods of producing any of the GPR75 polypeptides or fragments thereof disclosed herein. Such GPR75 polypeptides or fragments thereof can be produced by any suitable method.

The present disclosure also provides cells comprising any one or more of the nucleic acid molecules and/or any one or more of the polypeptides disclosed herein. The cells can be in vitro, ex vivo, or in vivo. Nucleic acid molecules can be linked to a promoter and other regulatory sequences so they are expressed to produce an encoded protein.

In some embodiments, the cell is a totipotent cell or a pluripotent cell such as, for example, an embryonic stem (ES) cell such as a rodent ES cell, a mouse ES cell, or a rat ES cell. In some embodiments, the cell is a primary somatic cell, or a cell that is not a primary somatic cell. The cell can be from any source. For example, the cell can be a eukaryotic cell, an animal cell, a plant cell, or a fungal (such as, for example, yeast) cell. Such cells can be fish cells or bird cells, or such cells can be mammalian cells, such as human cells, non-human mammalian cells, rodent cells, mouse cells or rat cells. Mammals include, but are not limited to, humans, non-human primates, monkeys, apes, cats dogs, horses, bulls, deer, bison, sheep, rodents (such as, for example, mice, rats, hamsters, guinea pigs), livestock (such as, for example, bovine species such as cows, steer, etc.; ovine species such as sheep, goats, etc.; and porcine species such as pigs and boars). The term "non-human animal" excludes humans.

The nucleotide and amino acid sequences listed in the accompanying sequence listing are shown using standard letter abbreviations for nucleotide bases, and three-letter code for amino acids. The nucleotide sequences follow the standard convention of beginning at the 5' end of the sequence and proceeding forward (i.e., from left to right in each line) to the 3' end. Only one strand of each nucleotide sequence is shown, but the complementary strand is understood to be included by any reference to the displayed strand. The amino acid sequence follows the standard convention of beginning at the amino terminus of the sequence and proceeding forward (i.e., from left to right in each line) to the carboxy terminus.

The present disclosure also provides therapeutic agents that treat or inhibit obesity for use in the treatment of obesity (or for use in the preparation of a medicament for treating obesity) in a subject, wherein the subject has any of the genomic nucleic acid molecules, mRNA molecules, and/or cDNA molecules encoding a human GPR75 polypeptide described herein. The therapeutic agents that treat or inhibit obesity can be any of the therapeutic agents that treat or inhibit obesity described herein.

In some embodiments, the subject comprises: i) a genomic nucleic acid molecule having a nucleotide sequence encoding a human GPR75 polypeptide, wherein the nucleotide sequence lacks a CCAGTAG heptanucleotide at positions corresponding to positions 5,540-5,546 according to SEQ ID NO:1, or the complement thereof; ii) an mRNA molecule having a nucleotide sequence encoding a human GPR75 polypeptide, wherein the nucleotide sequence: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; or lacks a CCAGUAG heptanucleotide at positions corresponding to positions 600-606 according to SEQ ID NO:10, or the complement thereof; or iii) a cDNA molecule having a nucleotide sequence encoding a human GPR75 polypeptide, wherein the nucleotide sequence: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; or lacks a CCAGTAG heptanucleotide at positions corresponding to positions 600-606 according to SEQ ID NO:34, or the complement thereof.

In some embodiments, the subject comprises: a genomic nucleic acid molecule having a nucleotide sequence encoding a human GPR75 polypeptide, wherein the nucleotide sequence lacks a CCAGTAG heptanucleotide at a position corresponding to positions 5,540-5,546 according to SEQ ID NO:1, or the complement thereof; an mRNA molecule having a nucleotide sequence encoding a human GPR75 polypeptide, wherein the nucleotide sequence lacks a CCAGUAG heptanucleotide at positions corresponding to positions 539-545 according to SEQ ID NO:7, or the complement thereof; a cDNA molecule having a nucleotide sequence encoding a human GPR75 polypeptide, wherein the nucleotide sequence lacks a CCAGTAG heptanucleotide at positions corresponding to positions 539-545 according to SEQ ID NO:31, or the complement thereof.

In some embodiments, the subject comprises: i) a genomic nucleic acid molecule having a nucleotide sequence encoding a human GPR75 polypeptide, wherein the nucleotide sequence comprises an adenine at a position corresponding to position 5,557 according to SEQ ID NO:3, or the complement thereof; ii) an mRNA molecule having a nucleotide sequence encoding a human GPR75 polypeptide, wherein the nucleotide sequence comprises: an adenine at a position corresponding to position 556 according to SEQ ID NO:12, or the complement thereof; an adenine at a position corresponding to position 457 according to SEQ ID NO:17, or the complement thereof; an adenine at a position corresponding to position 378 according to SEQ ID NO:22, or the complement thereof; or an adenine at a position corresponding to position 617 according to SEQ ID NO:27, or the complement thereof; or iii) a cDNA molecule having a nucleotide sequence encoding a human GPR75 polypeptide, wherein the nucleotide sequence comprises: an adenine at a position corresponding to position 556 according to SEQ ID NO:36, or the complement thereof; an adenine at a position corresponding to position 457 according to SEQ ID NO:41, or the complement thereof; an adenine at a position corresponding to position 378 according to SEQ ID NO:46, or the complement thereof; an adenine at a position corresponding to position 617 according to SEQ ID NO:51, or the complement thereof.

In some embodiments, the subject comprises: a genomic nucleic acid molecule having a nucleotide sequence encoding a human GPR75 polypeptide, wherein the nucleotide sequence comprises an adenine at a position corresponding to position 5,557 according to SEQ ID NO:3, or the complement thereof; an mRNA molecule having a nucleotide sequence encoding a human GPR75 polypeptide, wherein the nucleotide sequence comprises an adenine at a position corresponding to position 556 according to SEQ ID NO:12, or the complement thereof; a cDNA molecule having a nucleotide sequence encoding a human GPR75 polypeptide, wherein the nucleotide sequence comprises an adenine at a position corresponding to position 556 according to SEQ ID NO:36, or the complement thereof.

In some embodiments, the subject comprises: i) a genomic nucleic acid molecule having a nucleotide sequence encoding a human GPR75 polypeptide, wherein the nucleotide sequence comprises a thymine at a position corresponding to position 5,911 according to SEQ ID NO:4, or the complement thereof; ii) an mRNA molecule having a nucleotide sequence encoding a human GPR75 polypeptide, wherein the nucleotide sequence comprises: a uracil at a position corresponding to position 910 according to SEQ ID NO:13, or the complement thereof; a uracil at a position corresponding to position 811 according to SEQ ID NO:18, or the complement thereof; a uracil at a position corresponding to position 732 according to SEQ ID NO:23, or the complement thereof; or a uracil at a position corresponding to position 971 according to SEQ ID NO:28, or the complement thereof; or iii) a cDNA molecule having a nucleotide sequence encoding a human GPR75 polypeptide, wherein the nucleotide sequence comprises: a thymine at a position corresponding to position 910 according to SEQ ID NO:37, or the complement thereof; a thymine at a position corresponding to position 811 according to SEQ ID NO:42, or the complement thereof; a thymine at a position corresponding to position 732 according to SEQ ID NO:47, or the complement thereof; or a thymine at a position corresponding to position 971 according to SEQ ID NO:52, or the complement thereof.

In some embodiments, the subject comprises: a genomic nucleic acid molecule having a nucleotide sequence encoding a human GPR75 polypeptide, wherein the nucleotide sequence comprises a thymine at a position corresponding to position 5,991 according to SEQ ID NO:4, or the complement thereof; an mRNA molecule having a nucleotide sequence encoding a human GPR75 polypeptide, wherein the nucleotide sequence comprises a uracil at a position corresponding to position 910 according to SEQ ID NO:13, or the complement thereof; a cDNA molecule having a nucleotide sequence encoding a human GPR75 polypeptide, wherein the nucleotide sequence comprises a thymine at a position corresponding to position 910 according to SEQ ID NO:37, or the complement thereof; or a GPR75 polypeptide that comprises a stop codon at a position corresponding to position 234 according to SEQ ID NO:58.

In some embodiments, the subject comprises: i) a genomic nucleic acid molecule having a nucleotide sequence encoding a human GPR75 polypeptide, wherein the nucleotide sequence lacks an AAAG tetranucleotide at positions corresponding to positions 5,920-5,923 according to SEQ ID NO:1, or the complement thereof; ii) an mRNA molecule having a nucleotide sequence encoding a human GPR75 polypeptide, wherein the nucleotide sequence: lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; or lacks an AAAG tetranucleotide at positions corresponding to positions 980-983 according to SEQ ID NO:10, or the complement thereof; or iii) a cDNA molecule having a nucleotide sequence encoding a human GPR75 polypeptide, wherein the nucleotide sequence: lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; or lacks an AAAG tetranucleotide at positions corresponding to positions 980-983 according to SEQ ID NO:34, or the complement thereof.

In some embodiments, the subject comprises: a genomic nucleic acid molecule having a nucleotide sequence encoding a human GPR75 polypeptide, wherein the nucleotide sequence lacks an AAAG heptanucleotide at a position corresponding to positions 5,920-5,923 according to SEQ ID NO:1, or the complement thereof; an mRNA molecule having a nucleotide sequence encoding a human GPR75 polypeptide, wherein the nucleotide sequence lacks an AAAG tetranucleotide at positions corresponding to positions 919-922 according to SEQ ID NO:7, or the complement thereof; or a cDNA molecule having a nucleotide sequence encoding a human GPR75 polypeptide, wherein the nucleotide sequence lacks an AAAG tetranucleotide at positions corresponding to positions 919-922 according to SEQ ID NO:31, or the complement thereof.

In some embodiments, the subject comprises: i) a genomic nucleic acid molecule having a nucleotide sequence encoding a human GPR75 polypeptide, wherein the nucleotide sequence comprises an insertion of a thymine at a position corresponding to position 6,411 according to SEQ ID NO:6, or the complement thereof; ii) an mRNA molecule having a nucleotide sequence encoding a human GPR75 polypeptide, wherein the nucleotide sequence comprises: an insertion of a uracil at a position corresponding to position 1,410 according to SEQ ID NO:15, or the complement thereof; an insertion of a uracil at a position corresponding to position 1,311 according to SEQ ID NO:20, or the complement thereof; an insertion of a uracil at a position corresponding to position 1,232 according to SEQ ID NO:25, or the complement thereof; or an insertion of a uracil at a position corresponding to position 1,471 according to SEQ ID NO:30, or the complement thereof; or iii) a cDNA molecule having a nucleotide sequence encoding a human GPR75 polypeptide, wherein the nucleotide sequence comprises: an insertion of a thymine at a position corresponding to position 1,410 according to SEQ ID NO:39, or the complement thereof; an insertion of a thymine at a position corresponding to position 1,311 according to SEQ ID NO:44, or the complement thereof; an insertion of a thymine at a position corresponding to position 1,232 according to SEQ ID NO:49, or the complement thereof; or an insertion of a thymine at a position corresponding to position 1,471 according to SEQ ID NO:54, or the complement thereof.

In some embodiments, the subject comprises: a genomic nucleic acid molecule having a nucleotide sequence encoding a human GPR75 polypeptide, wherein the nucleotide sequence comprises an insertion of thymine at a position corresponding to position 6,411 according to SEQ ID NO:6, or the complement thereof; an mRNA molecule having a nucleotide sequence encoding a human GPR75 polypeptide, wherein the nucleotide sequence comprises an insertion of a uracil at a position corresponding to position 1,410 according to SEQ ID NO:15, or the complement thereof; or a cDNA molecule having a nucleotide sequence encoding a human GPR75 polypeptide, wherein the nucleotide sequence comprises an insertion of a thymine at a position corresponding to position 1,410 according to SEQ ID NO:39, or the complement thereof.

In some embodiments, the subject comprises: i) a genomic nucleic acid molecule having a nucleotide sequence encoding a human GPR75 polypeptide, wherein the nucleotide sequence comprises a guanine at a position corresponding to position 5,831 according to SEQ ID NO:99, or the complement thereof; ii) an mRNA molecule having a nucleotide sequence encoding a human GPR75 polypeptide, wherein the nucleotide sequence comprises: a guanine at a position corresponding to position 830 according to SEQ ID NO:100, or the complement thereof; a guanine at a position corresponding to position 731 according to SEQ ID NO:101, or the complement thereof; a guanine at a position corresponding to position 652 according to SEQ ID NO:102, or the complement thereof; or a guanine at a position corresponding to position 891 according to SEQ ID NO:103, or the complement thereof; or iii) a cDNA molecule having a nucleotide sequence encoding a human GPR75 polypeptide, wherein the nucleotide sequence comprises: a guanine at a position corresponding to position 830 according to SEQ ID NO:104, or the complement thereof; a guanine at a position corresponding to position 731 according to SEQ ID NO:105, or the complement thereof; a guanine at a position corresponding to position 652 according to SEQ ID NO:106, or the complement thereof; or a guanine at a position corresponding to position 891 according to SEQ ID NO:107, or the complement thereof.

In some embodiments, the subject comprises: a genomic nucleic acid molecule having a nucleotide sequence encoding a human GPR75 polypeptide, wherein the nucleotide sequence comprises a guanine at a position corresponding to position 5,831 according to SEQ ID NO:99, or the complement thereof; an mRNA molecule having a nucleotide sequence encoding a human GPR75 polypeptide, wherein the nucleotide sequence comprises a guanine at a position corresponding to position 830 according to SEQ ID NO:100, or the complement thereof; a cDNA molecule having a nucleotide sequence encoding a human GPR75 polypeptide, wherein the nucleotide sequence comprises a guanine at a position corresponding to position 830 according to SEQ ID NO:104, or the complement thereof; or a GPR75 polypeptide that comprises a cysteine at a position corresponding to position 207 according to SEQ ID NO:108.

The present disclosure also provides GPR75 inhibitors for use in the treatment of obesity (or for use in the preparation of a medicament for treating obesity) in a subject, wherein the subject has any of the genomic nucleic acid molecules, mRNA molecules, and/or cDNA molecules encoding a human GPR75 polypeptide described herein. The GPR75 inhibitors can be any of the GPR75 inhibitors described herein.

In some embodiments, the subject comprises: i) a genomic nucleic acid molecule having a nucleotide sequence encoding a human GPR75 polypeptide, wherein the nucleotide sequence lacks a CCAGTAG heptanucleotide at positions corresponding to positions 5,540-5,546 according to SEQ ID NO:1, or the complement thereof; ii) an mRNA molecule having a nucleotide sequence encoding a human GPR75 polypeptide, wherein the nucleotide sequence: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; or lacks a CCAGUAG heptanucleotide at positions corresponding to positions 600-606 according to SEQ ID NO:10, or the complement thereof; or iii) a cDNA molecule having a nucleotide sequence encoding a human GPR75 polypeptide, wherein the nucleotide sequence: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; or lacks a CCAGTAG heptanucleotide at positions corresponding to positions 600-606 according to SEQ ID NO:34, or the complement thereof.

In some embodiments, the subject comprises: a genomic nucleic acid molecule having a nucleotide sequence encoding a human GPR75 polypeptide, wherein the nucleotide sequence lacks a CCAGTAG heptanucleotide at a position corresponding to positions 5,540-5,546 according to SEQ ID NO:1, or the complement thereof; an mRNA molecule having a nucleotide sequence encoding a human GPR75 polypeptide, wherein the nucleotide sequence lacks a CCAGUAG heptanucleotide at positions corresponding to positions 539-545 according to SEQ ID NO:7, or the complement thereof; a cDNA molecule having a nucleotide sequence encoding a human GPR75 polypeptide, wherein the nucleotide sequence lacks a CCAGTAG heptanucleotide at positions corresponding to positions 539-545 according to SEQ ID NO:31, or the complement thereof.

In some embodiments, the subject comprises: i) a genomic nucleic acid molecule having a nucleotide sequence encoding a human GPR75 polypeptide, wherein the nucleotide sequence comprises an adenine at a position corresponding to position 5,557 according to SEQ ID NO:3, or the complement thereof; ii) an mRNA molecule having a nucleotide sequence encoding a human GPR75 polypeptide, wherein the nucleotide sequence comprises: an adenine at a position corresponding to position 556 according to SEQ ID NO:12, or the complement thereof; an adenine at a position corresponding to position 457 according to SEQ ID NO:17, or the complement thereof; an adenine at a position corresponding to position 378 according to SEQ ID NO:22, or the complement thereof; or an adenine at a position corresponding to position 617 according to SEQ ID NO:27, or the complement thereof; or iii) a cDNA molecule having a nucleotide sequence encoding a human GPR75 polypeptide, wherein the nucleotide sequence comprises: an adenine at a position corresponding to position 556 according to SEQ ID NO:36, or the complement thereof; an adenine at a position corresponding to position 457 according to SEQ ID NO:41, or the complement thereof; an adenine at a position corresponding to position 378 according to SEQ ID NO:46, or the complement thereof; an adenine at a position corresponding to position 617 according to SEQ ID NO:51, or the complement thereof.

In some embodiments, the subject comprises: a genomic nucleic acid molecule having a nucleotide sequence encoding a human GPR75 polypeptide, wherein the nucleotide sequence comprises an adenine at a position corresponding to position 5,557 according to SEQ ID NO:3, or the complement thereof; an mRNA molecule having a nucleotide sequence encoding a human GPR75 polypeptide, wherein the nucleotide sequence comprises an adenine at a position corresponding to position 556 according to SEQ ID NO:12, or the complement thereof; a cDNA molecule having a nucleotide sequence encoding a human GPR75 polypeptide, wherein the nucleotide sequence comprises an adenine at a position corresponding to position 556 according to SEQ ID NO:36, or the complement thereof.

In some embodiments, the subject comprises: i) a genomic nucleic acid molecule having a nucleotide sequence encoding a human GPR75 polypeptide, wherein the nucleotide sequence comprises a thymine at a position corresponding to position 5,911 according to SEQ ID NO:4, or the complement thereof; ii) an mRNA molecule having a nucleotide sequence encoding a human GPR75 polypeptide, wherein the nucleotide sequence comprises: a uracil at a position corresponding to position 910 according to SEQ ID NO:13, or the complement thereof; a uracil at a position corresponding to position 811 according to SEQ ID NO:18, or the complement thereof; a uracil at a position corresponding to position 732 according to SEQ ID NO:23, or the complement thereof; or a uracil at a position corresponding to position 971 according to SEQ ID NO:28, or the complement thereof; or iii) a cDNA molecule having a nucleotide sequence encoding a human GPR75 polypeptide, wherein the nucleotide sequence comprises: a thymine at a position corresponding to position 910 according to SEQ ID NO:37, or the complement thereof; a thymine at a position corresponding to position 811 according to SEQ ID NO:42, or the complement thereof; a thymine at a position corresponding to position 732 according to SEQ ID NO:47, or the complement thereof; or a thymine at a position corresponding to position 971 according to SEQ ID NO:52, or the complement thereof.

In some embodiments, the subject comprises: a genomic nucleic acid molecule having a nucleotide sequence encoding a human GPR75 polypeptide, wherein the nucleotide sequence comprises a thymine at a position corresponding to position 5,991 according to SEQ ID NO:4, or the complement thereof; an mRNA molecule having a nucleotide sequence encoding a human GPR75 polypeptide, wherein the nucleotide sequence comprises a uracil at a position corresponding to position 910 according to SEQ ID NO:13, or the complement thereof; a cDNA molecule having a nucleotide sequence encoding a human GPR75 polypeptide, wherein the nucleotide sequence comprises a thymine at a position corresponding to position 910 according to SEQ ID NO:37, or the complement thereof; or a GPR75 polypeptide that comprises a stop codon at a position corresponding to position 234 according to SEQ ID NO:58.

In some embodiments, the subject comprises: i) a genomic nucleic acid molecule having a nucleotide sequence encoding a human GPR75 polypeptide, wherein the nucleotide sequence lacks an AAAG tetranucleotide at positions corresponding to positions 5,920-5,923 according to SEQ ID NO:1, or the complement thereof; ii) an mRNA molecule having a nucleotide sequence encoding a human GPR75 polypeptide, wherein the nucleotide sequence: lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; or lacks an AAAG tetranucleotide at positions corresponding to positions 980-983 according to SEQ ID NO:10, or the complement thereof; or iii) a cDNA molecule having a nucleotide sequence encoding a human GPR75 polypeptide, wherein the nucleotide sequence: lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; or lacks an AAAG tetranucleotide at positions corresponding to positions 980-983 according to SEQ ID NO:34, or the complement thereof.

In some embodiments, the subject comprises: a genomic nucleic acid molecule having a nucleotide sequence encoding a human GPR75 polypeptide, wherein the nucleotide sequence lacks an AAAG heptanucleotide at a position corresponding to positions 5,920-5,923 according to SEQ ID NO:1, or the complement thereof; an mRNA molecule having a nucleotide sequence encoding a human GPR75 polypeptide, wherein the nucleotide sequence lacks an AAAG tetranucleotide at positions corresponding to positions 919-922 according to SEQ ID NO:7, or the complement thereof; or a cDNA molecule having a nucleotide sequence encoding a human GPR75 polypeptide, wherein the nucleotide sequence lacks an AAAG tetranucleotide at positions corresponding to positions 919-922 according to SEQ ID NO:31, or the complement thereof.

In some embodiments, the subject comprises: i) a genomic nucleic acid molecule having a nucleotide sequence encoding a human GPR75 polypeptide, wherein the nucleotide sequence comprises an insertion of a thymine at a position corresponding to position 6,411 according to SEQ ID NO:6, or the complement thereof; ii) an mRNA molecule having a nucleotide sequence encoding a human GPR75 polypeptide, wherein the nucleotide sequence comprises: an insertion of a uracil at a position corresponding to position 1,410 according to SEQ ID NO:15, or the complement thereof; an insertion of a uracil at a position corresponding to position 1,311 according to SEQ ID NO:20, or the complement thereof; an insertion of a uracil at a position corresponding to position 1,232 according to SEQ ID NO:25, or the complement thereof; or an insertion of a uracil at a position corresponding to position 1,471 according to SEQ ID NO:30, or the complement thereof; or iii) a cDNA molecule having a nucleotide sequence encoding a human GPR75 polypeptide, wherein the nucleotide sequence comprises: an insertion of a thymine at a position corresponding to position 1,410 according to SEQ ID NO:39, or the complement thereof; an insertion of a thymine at a position corresponding to position 1,311 according to SEQ ID NO:44, or the complement thereof; an insertion of a thymine at a position corresponding to position 1,232 according to SEQ ID NO:49, or the complement thereof; or an insertion of a thymine at a position corresponding to position 1,471 according to SEQ ID NO:54, or the complement thereof.

In some embodiments, the subject comprises: a genomic nucleic acid molecule having a nucleotide sequence encoding a human GPR75 polypeptide, wherein the nucleotide sequence comprises an insertion of thymine at a position corresponding to position 6,411 according to SEQ ID NO:6, or the complement thereof; an mRNA molecule having a nucleotide sequence encoding a human GPR75 polypeptide, wherein the nucleotide sequence comprises an insertion of a uracil at a position corresponding to position 1,410 according to SEQ ID NO:15, or the complement thereof; or a cDNA molecule having a nucleotide sequence encoding a human GPR75 polypeptide, wherein the nucleotide sequence comprises an insertion of a thymine at a position corresponding to position 1,410 according to SEQ ID NO:39, or the complement thereof.

In some embodiments, the subject comprises: i) a genomic nucleic acid molecule having a nucleotide sequence encoding a human GPR75 polypeptide, wherein the nucleotide sequence comprises a guanine at a position corresponding to position 5,831 according to SEQ ID NO:99, or the complement thereof; ii) an mRNA molecule having a nucleotide sequence encoding a human GPR75 polypeptide, wherein the nucleotide sequence comprises: a guanine at a position corresponding to position 830 according to SEQ ID NO:100, or the complement thereof; a guanine at a position corresponding to position 731 according to SEQ ID NO:101, or the complement thereof; a guanine at a position corresponding to position 652 according to SEQ ID NO:102, or the complement thereof; or a guanine at a position corresponding to position 891 according to SEQ ID NO:103, or the complement thereof; or iii) a cDNA molecule having a nucleotide sequence encoding a human GPR75 polypeptide, wherein the nucleotide sequence comprises: a guanine at a position corresponding to position 830 according to SEQ ID NO:100, or the complement thereof; a guanine at a position corresponding to position 731 according to SEQ ID NO:101, or the complement thereof; a guanine at a position corresponding to position 652 according to SEQ ID NO:102, or the complement thereof; or a guanine at a position corresponding to position 891 according to SEQ ID NO:103, or the complement thereof.

In some embodiments, the subject comprises: a genomic nucleic acid molecule having a nucleotide sequence encoding a human GPR75 polypeptide, wherein the nucleotide sequence comprises a guanine at a position corresponding to position 5,831 according to SEQ ID NO:99, or the complement thereof; an mRNA molecule having a nucleotide sequence encoding a human GPR75 polypeptide, wherein the nucleotide sequence comprises a guanine at a position corresponding to position 830 according to SEQ ID NO:100, or the complement thereof; a cDNA molecule having a nucleotide sequence encoding a human GPR75 polypeptide, wherein the nucleotide sequence comprises a guanine at a position corresponding to position 830 according to SEQ ID NO:104, or the complement thereof; or a GPR75 polypeptide that comprises a cysteine at a position corresponding to position 207 according to SEQ ID NO:108.

All patent documents, websites, other publications, accession numbers and the like cited above or below are incorporated by reference in their entirety for all purposes to the same extent as if each individual item were specifically and individually indicated to be so incorporated by reference. If different versions of a sequence are associated with an accession number at different times, the version associated with the accession number at the effective filing date of this application is meant. The effective filing date means the earlier of the actual filing date or filing date of a priority application referring to the accession number if applicable. Likewise, if different versions of a publication, website or the like are published at different times, the version most recently published at the effective filing date of the application is meant unless otherwise indicated. Any feature, step, element, embodiment, or aspect of the present disclosure can be used in combination with any other feature, step, element, embodiment, or aspect unless specifically indicated otherwise. Although the present disclosure has been described in some detail by way of illustration and example for purposes of clarity and understanding, it will be apparent that certain changes and modifications may be practiced within the scope of the appended claims.

The following representative embodiments are presented:

Embodiment 1. A method of treating a subject having obesity, the method comprising administering a G-Protein Coupled Receptor 75 (GPR75) inhibitor to the subject.

Embodiment 2. A method of treating a subject having excessive weight, the method comprising administering a GPR75 inhibitor to the subject.

Embodiment 3. A method of treating a subject having elevated BMI, the method comprising administering a GPR75 inhibitor to the subject.

Embodiment 4. A method of treating a subject having elevated body fat mass, percentage, or volume, the method comprising administering a GPR75 inhibitor to the subject.

Embodiment 5. A method of treating a subject having excessive food intake, or to prevent weight gain, or to maintain weight loss, the method comprising administering a GPR75 inhibitor to the subject.

Embodiment 6. The method according to any one of embodiments 1 to 5, wherein the GPR75 inhibitor comprises an antisense nucleic acid molecule, a small interfering RNA (siRNA), or a short hairpin RNA (shRNA) that hybridizes to a GPR75 mRNA.

Embodiment 7. The method according to any one of embodiments 1 to 5, wherein the GPR75 inhibitor comprises a Cas protein and guide RNA (gRNA) that hybridizes to a gRNA recognition sequence within a GPR75 genomic nucleic acid molecule.

Embodiment 8. The method according to embodiment 7, wherein the Cas protein is Cas9 or Cpf1.

Embodiment 9. The method according to embodiment 7 or embodiment 8, wherein the gRNA recognition sequence includes or is proximate to a position corresponding to: position 5,540-5,546 according to SEQ ID NO:1, position 5,557 according to SEQ ID NO:1, position 5,911 according to SEQ ID NO:1, positions 5,920-5,923 according to SEQ ID NO:1, position 6,411 according to SEQ ID NO:1, or position 5,831 according to SEQ ID NO:1.

Embodiment 10. The method according to embodiment 7 or embodiment 8, wherein the gRNA recognition sequence is located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to: position 5,540-5,546 according to SEQ ID NO:1, position 5,557 according to SEQ ID NO:1, position 5,911 according to SEQ ID NO:1, positions 5,920-5,923 according to SEQ ID NO:1, position 6,411 according to SEQ ID NO:1, or position 5,831 according to SEQ ID NO:1.

Embodiment 11. The method according to embodiment 7 or embodiment 8, wherein a Protospacer Adjacent Motif (PAM) sequence is about 2 to about 6 nucleotides downstream of the gRNA recognition sequence.

Embodiment 12. The method according to any one of embodiments 7 to 11, wherein the gRNA comprises from about 17 to about 23 nucleotides.

Embodiment 13. The method according to any one of embodiments 7 to 11, wherein the gRNA recognition sequence comprises a nucleotide sequence according to any one of SEQ ID NOs:61-98.

Embodiment 14. The method according to any one of embodiments 1 to 13, further comprising detecting the absence of a GPR75 missense variant nucleic acid molecule encoding a predicted loss-of-function GPR75 polypeptide in a biological sample from the subject.

Embodiment 15. The method according to embodiment 14, further comprising administering a therapeutic agent that treats or inhibits obesity in a standard dosage amount to a subject that is GPR75 reference.

Embodiment 16. The method according to embodiment 14, further comprising administering a therapeutic agent that treats or inhibits obesity in a dosage amount that is the same as or lower than a standard dosage amount to a subject that is heterozygous for a GPR75 missense variant nucleic acid molecule.

Embodiment 17. The method according to any one of embodiments 14 to 16, wherein the GPR75 missense variant nucleic acid molecule is a nucleic acid molecule encoding Ala110fs, Ala116Thr, Tyr207Cys, Gln234Stop, Arg236fs, or Cys400fs.

Embodiment 18. The method according to embodiment 17, wherein the GPR75 missense variant nucleic acid molecule is:

a genomic nucleic acid molecule having a nucleotide sequence: lacking a CCAGTAG heptanucleotide at positions corresponding to positions 5,540-5,546 according to SEQ ID NO:1; comprising an adenine at a position corresponding to position 5,557 according to SEQ ID NO:3; comprising a thymine at a position corresponding to position 5,911 according to SEQ ID NO:4; lacking an AAAG tetranucleotide at positions corresponding to positions 5,920-5,923 according to SEQ ID NO:1; comprising an insertion of a thymine at a position corresponding to position 6,411 according to SEQ ID NO:6; or comprising a guanine at a position corresponding to position 5,831 according to SEQ ID NO:99;

an mRNA molecule having a nucleotide sequence: lacking a CCAGUAG heptanucleotide at positions corresponding to positions 539-545 according to SEQ ID NO:7, lacking a CCAGUAG heptanucleotide at positions corresponding to positions 440-446 according to SEQ ID NO:8, lacking a CCAGUAG heptanucleotide at positions corresponding to positions 361-367 according to SEQ ID NO:9, lacking a CCAGUAG heptanucleotide at positions corresponding to positions 600-606 according to SEQ ID NO:10; comprising an adenine at a position corresponding to position 556 according to SEQ ID NO:12, comprising an adenine at a position corresponding to position 457 according to SEQ ID NO:17, comprising an adenine at a position corresponding to position 378 according to SEQ ID NO:22, comprising an adenine at a position corresponding to position 617 according to SEQ ID NO:27; comprising a uracil at a position corresponding to position 910 according to SEQ ID NO:13, comprising a uracil at a position corresponding to position 811 according to SEQ ID NO:18, comprising a uracil at a position corresponding to position 732 according to SEQ ID NO:23, comprising a uracil at a position corresponding to position 971 according to SEQ ID NO:28; lacking an AAAG tetranucleotide at positions corresponding to positions 919-922 according to SEQ ID NO:7, lacking an AAAG tetranucleotide at positions corresponding to positions 820-823 according to SEQ ID NO:8, lacking an AAAG tetranucleotide at positions corresponding to positions 741-744 according to SEQ ID NO:9, lacking an AAAG tetranucleotide at positions corresponding to positions 980-983 according to SEQ ID NO:10; comprising an insertion of a uracil at a position corresponding to position 1,410 according to SEQ ID NO:15, comprising an insertion of a uracil at a position corresponding to position 1,311 according to SEQ ID NO:20, comprising an insertion of a uracil at a position corresponding to position 1,232 according to SEQ ID NO:25, comprising an insertion of a uracil at a position corresponding to position 1,471 according to SEQ ID NO:30, comprising a guanine at a position corresponding to position 830 according to SEQ ID NO:100, comprising a guanine at a position corresponding to position 731 according to SEQ ID NO:101, comprising a guanine at a position corresponding to position 652 according to SEQ ID NO:102, or comprising a guanine at a position corresponding to position 891 according to SEQ ID NO:103; or a cDNA molecule produced from an mRNA molecule, wherein the cDNA molecule has a nucleotide sequence: lacking a CCAGTAG heptanucleotide at positions corresponding to positions 539-545 according to SEQ ID NO:31, lacking a CCAGTAG heptanucleotide at positions corresponding to positions 440-446 according to SEQ ID NO:32, lacking a CCAGTAG heptanucleotide at positions corresponding to positions 361-367 according to SEQ ID NO:33, lacking a CCAGTAG heptanucleotide at positions corresponding to positions 600-606 according to SEQ ID NO:34; comprising an adenine at a position corresponding to position 556 according to SEQ ID NO:36, comprising an adenine at a position corresponding to position 457 according to SEQ ID NO:41, comprising an adenine at a position corresponding to position 378 according to SEQ ID NO:46, comprising an adenine at a position corresponding to position 617 according to SEQ ID NO:51; comprising a thymine at a position corresponding to position 910 according to SEQ ID NO:37, comprising a thymine at a position corresponding to position 811 according to SEQ ID NO:42, comprising a thymine at a position corresponding to position 732 according to SEQ ID NO:47, comprising a thymine at a position corresponding to position 971 according to SEQ ID NO:52; lacking an AAAG tetranucleotide at positions corresponding to positions 919-922 according to SEQ ID NO:31, lacking an AAAG tetranucleotide at positions corresponding to positions 820-823 according to SEQ ID NO:32, lacking an AAAG tetranucleotide at positions corresponding to positions 741-744 according to SEQ ID NO:33, lacking an AAAG tetranucleotide at positions corresponding to positions 980-983 according to SEQ ID NO:34; comprising an insertion of a thymine at a position corresponding to position 1,410 according to SEQ ID NO:39, comprising an insertion of a thymine at a position corresponding to position 1,311 according to SEQ ID NO:44, comprising an insertion of a thymine at a position corresponding to position 1,232 according to SEQ ID NO:49, comprising an insertion of a thymine at a position corresponding to position 1,471 according to SEQ ID NO:54, comprising a guanine at a position corresponding to position 830 according to SEQ ID NO:104, comprising a guanine at a position corresponding to position 731 according to SEQ ID NO:105, comprising a guanine at a position corresponding to position 652 according to SEQ ID NO:106, or comprising a guanine at a position corresponding to position 891 according to SEQ ID NO:107.

Embodiment 19. The method according to any one of embodiments 14 to 18, wherein the detecting step is carried out in vitro.

Embodiment 20. The method according to any one of embodiments 14 to 19, wherein the detecting step comprises sequencing at least a portion of the nucleotide sequence of the GPR75 genomic nucleic acid molecule in the biological sample, wherein the sequenced portion comprises a position corresponding to: positions 5,540-5,546 according to SEQ ID NO:2 or SEQ ID NO:1, or the complement thereof; position 5,557 according to SEQ ID NO:3, or the complement thereof; position 5,911 according to SEQ ID NO:4, or the complement thereof; positions 5,920-5,923 according to SEQ ID NO:5 or SEQ ID NO:1, or the complement thereof; position 6,411 according to SEQ ID NO:6, or the complement thereof; or position 5,831 according to SEQ ID NO:99, or the complement thereof;

wherein when the sequenced portion of the GPR75 genomic nucleic acid molecule in the biological sample: lacks a CCAGTAG heptanucleotide at positions corresponding to positions 5,540-5,546 according to SEQ ID NO:1; comprises an adenine at a position corresponding to position 5,557 according to SEQ ID NO:3; comprises a thymine at a position corresponding to position 5,911 according to SEQ ID NO:4; lacks an AAAG tetranucleotide at positions corresponding to positions 5,920-5,923 according to SEQ ID NO:1; comprises an insertion of a thymine at a position corresponding to position 6,411 according to SEQ ID NO:6; or comprises a guanine at a position corresponding to position 5,831 according to SEQ ID NO:99, or the complement thereof; then the GPR75 genomic nucleic acid molecule in the biological sample is a GPR75 missense variant nucleic acid molecule.

Embodiment 21. The method according to any one of embodiments 14 to 19, wherein the detecting step comprises sequencing at least a portion of the nucleotide sequence of the GPR75 mRNA molecule in the biological sample, wherein the sequenced portion comprises a position corresponding to: positions 539-545 according to SEQ ID NO:11, or the complement thereof; positions 440-446 according to SEQ ID NO:16, or the complement thereof; positions 361-367 according to SEQ ID NO:21, or the complement thereof; positions 600-606 according to SEQ ID NO:26, or the complement thereof; position 556 according to SEQ ID NO:12, or the complement thereof; position 457 according to SEQ ID NO:17, or the complement thereof; position 378 according to SEQ ID NO:22, or the complement thereof; position 617 according to SEQ ID NO:27, or the complement thereof; position 910 according to SEQ ID NO:13, or the complement thereof; position 811 according to SEQ ID NO:18, or the complement thereof; position 732 according to SEQ ID NO:23, or the complement thereof; position 971 according to SEQ ID NO:28, or the complement thereof; positions 919-922 according to SEQ ID NO:14, or the complement thereof; positions 820-823 according to SEQ ID NO:19, or the complement thereof; positions 741-744 according to SEQ ID NO:24, or the complement thereof; positions 980-983 according to SEQ ID NO:29, or the complement thereof; position 1,410 according to SEQ ID NO:15, or the complement thereof; position 1,311 according to SEQ ID NO:20, or the complement thereof; position 1,232 according to SEQ ID NO:25, or the complement thereof; position 1,471 according to SEQ ID NO:30, or the complement thereof; position 830 according to SEQ ID NO:100, or the complement thereof; position 731 according to SEQ ID NO:101, or the complement thereof; position 652 according to SEQ ID NO:102, or the complement thereof; position 891 according to SEQ ID NO:103, or the complement thereof;

wherein when the sequenced portion of the GPR75 mRNA molecule in the biological sample: lacks a CCAGUAG heptanucleotide at positions corresponding to positions 539-545 according to SEQ ID NO:7; lacks a CCAGUAG heptanucleotide at positions corresponding to positions 440-446 according to SEQ ID NO:8; lacks a CCAGUAG heptanucleotide at positions corresponding to positions 361-367 according to SEQ ID NO:9; lacks a CCAGUAG heptanucleotide at positions corresponding to positions 600-606 according to SEQ ID NO:10; comprises an adenine at a position corresponding to position 556 according to SEQ ID NO:12; comprises an adenine at a position corresponding to position 457 according to SEQ ID NO:17; comprises an adenine at a position corresponding to position 378 according to SEQ ID NO:22; comprises an adenine at a position corresponding to position 617 according to SEQ ID NO:27; comprises a uracil at a position corresponding to position 910 according to SEQ ID NO:13; comprises a uracil at a position corresponding to position 811 according to SEQ ID NO:18; comprises a uracil at a position corresponding to position 732 according to SEQ ID NO:23; comprises a uracil at a position corresponding to position 971 according to SEQ ID NO:28; lacks an AAAG tetranucleotide at positions corresponding to positions 919-922 according to SEQ ID NO:7; lacks an AAAG tetranucleotide at positions corresponding to positions 820-823 according to SEQ ID NO:8; lacks an AAAG tetranucleotide at positions corresponding to positions 741-744 according to SEQ ID NO:9; lacks an AAAG tetranucleotide at positions corresponding to positions 980-983 according to SEQ ID NO:10; comprises an insertion of a uracil at a position corresponding to position 1,410 according to SEQ ID NO:15; comprises an insertion of a uracil at a position corresponding to position 1,311 according to SEQ ID NO:20; comprises an insertion of a uracil at a position corresponding to position 1,232 according to SEQ ID NO:25; comprises an insertion of a uracil at a position corresponding to position 1,471 according to SEQ ID NO:30; comprises a guanine at a position corresponding to position 830 according to SEQ ID NO:100; comprises a guanine at a position corresponding to position 731 according to SEQ ID NO:101; comprises a guanine at a position corresponding to position 652 according to SEQ ID NO:102; or comprises a guanine at a position corresponding to position 891 according to SEQ ID NO:103, then the GPR75 mRNA molecule in the biological sample is a GPR75 missense variant mRNA molecule.

Embodiment 22. The method according to any one of embodiments 14 to 19, wherein the detecting step comprises sequencing at least a portion of the nucleotide sequence of the GPR75 cDNA molecule produced from an mRNA molecule in the biological sample, wherein the sequenced portion comprises a position corresponding to: positions 539-545 according to SEQ ID NO:35, or the complement thereof; positions 440-446 according to SEQ ID NO:40, or the complement thereof; positions 361-367 according to SEQ ID NO:45, or the complement thereof; positions 600-606 according to SEQ ID NO:50, or the complement thereof; position 556 according to SEQ ID NO:36, or the complement thereof; position 457 according to SEQ ID NO:41, or the complement thereof; position 378 according to SEQ ID NO:46, or the complement thereof; position 617 according to SEQ ID NO:51, or the complement thereof; position 910 according to SEQ ID NO:37, or the complement thereof; position 811 according to SEQ ID NO:42, or the complement thereof; position 732 according to SEQ ID NO:47, or the complement thereof; position 971 according to SEQ ID NO:52, or the complement thereof; positions 919-922 according to SEQ ID NO:38, or the complement thereof; positions 820-823 according to SEQ ID NO:43, or the complement thereof; positions 741-744 according to SEQ ID NO:48, or the complement thereof; positions 980-983 according to SEQ ID NO:53, or the complement thereof; position 1,410 according to SEQ ID NO:39, or the complement thereof; position 1,311 according to SEQ ID NO:44, or the complement thereof; position 1,232 according to SEQ ID NO:49, or the complement thereof; position 1,471 according to SEQ ID NO:54, or the complement thereof; position 830 according to SEQ ID NO:104, or the complement thereof; position 731 according to SEQ ID NO:105, or the complement thereof; position 652 according to SEQ ID NO:106, or the complement thereof; or position 891 according to SEQ ID NO:107, or the complement thereof;

wherein when the sequenced portion of the GPR75 cDNA molecule in the biological sample: lacks a CCAGTAG heptanucleotide at positions corresponding to positions 539-545 according to SEQ ID NO:31; lacks a CCAGTAG heptanucleotide at positions corresponding to positions 440-446 according to SEQ ID NO:32; lacks a CCAGTAG heptanucleotide at positions corresponding to positions 361-367 according to SEQ ID NO:33; lacks a CCAGTAG heptanucleotide at positions corresponding to positions 600-606 according to SEQ ID NO:34; comprises an adenine at a position corresponding to position 556 according to SEQ ID NO:36; comprises an adenine at a position corresponding to position 457 according to SEQ ID NO:41; comprises an adenine at a position corresponding to position 378 according to SEQ ID NO:46; comprises an adenine at a position corresponding to position 617 according to SEQ ID NO:51; comprises a thymine at a position corresponding to position 910 according to SEQ ID NO:37; comprises a thymine at a position corresponding to position 811 according to SEQ ID NO:42; comprises a thymine at a position corresponding to position 732 according to SEQ ID NO:47; comprises a thymine at a position corresponding to position 971 according to SEQ ID NO:52; lacks an AAAG tetranucleotide at positions corresponding to positions 919-922 according to SEQ ID NO:31; lacks an AAAG tetranucleotide at positions corresponding to positions 820-823 according to SEQ ID NO:32; lacks an AAAG tetranucleotide at positions corresponding to positions 741-744 according to SEQ ID NO:33; lacks an AAAG tetranucleotide at positions corresponding to positions 980-983 according to SEQ ID NO:34; comprises an insertion of a thymine at a position corresponding to position 1,410 according to SEQ ID NO:39; comprises an insertion of a thymine at a position corresponding to position 1,311 according to SEQ ID NO:44; comprises an insertion of a thymine at a position corresponding to position 1,232 according to SEQ ID NO:49; comprises an insertion of a thymine at a position corresponding to position 1,471 according to SEQ ID NO:54; comprises a guanine at a position corresponding to position 830 according to SEQ ID NO:104; comprises a guanine at a position corresponding to position 731 according to SEQ ID NO:105; comprises a guanine at a position corresponding to position 652 according to SEQ ID NO:106; or comprises a guanine at a position corresponding to position 891 according to SEQ ID NO:107, then the GPR75 cDNA molecule in the biological sample is a GPR75 missense variant cDNA molecule.

Embodiment 23. The method according to any one of embodiments 14 to 19, wherein the detecting step comprises:

a) contacting the biological sample with a primer hybridizing to a portion of the nucleotide sequence of the GPR75 genomic nucleic acid molecule that is proximate to a position corresponding to: positions 5,540-5,546 according to SEQ ID NO:2, position 5,557 according to SEQ ID NO:3, position 5,911 according to SEQ ID NO:4, positions 5,920-5,923 according to SEQ ID NO:5, position 6,411 according to SEQ ID NO:6, or position 5,831 according to SEQ ID NO:99;

b) extending the primer at least through the position of the nucleotide sequence of the GPR75 genomic nucleic acid molecule corresponding to: positions 5,540-5,546 according to SEQ ID NO:2, position 5,557 according to SEQ ID NO:3, position 5,911 according to SEQ ID NO:4, positions 5,920-5,923 according to SEQ ID NO:5, position 6,411 according to SEQ ID NO:6, or position 5,831 according to SEQ ID NO:99; and c) determining whether the extension product of the primer: lacks a CCAGTAG heptanucleotide at positions corresponding to positions 5,540-5,546 according to SEQ ID NO:1, comprises an adenine at a position corresponding to position 5,557 according to SEQ ID NO:3, comprises a thymine at a position corresponding to position 5,911 according to SEQ ID NO:4, lacks an AAAG tetranucleotide at positions corresponding to positions 5,920-5,923 according to SEQ ID NO:1, comprises an insertion of thymine at a position corresponding to position 6,411 according to SEQ ID NO:6, or comprises a guanine at a position corresponding to position 5,831 according to SEQ ID NO:99.

Embodiment 24. The method according to any one of embodiments 14 to 19, wherein the detecting step comprises:

a) contacting the biological sample with a primer hybridizing to a portion of the nucleotide sequence of the GPR75 mRNA molecule that is proximate to a position corresponding to: positions 539-545 according to SEQ ID NO:11, positions 440-446 according to SEQ ID NO:16, positions 361-367 according to SEQ ID NO:21, positions 600-606 according to SEQ ID NO:26, position 556 according to SEQ ID NO:12, position 457 according to SEQ ID NO:17, position 378 according to SEQ ID NO:22, position 617 according to SEQ ID NO:27, position 910 according to SEQ ID NO:13, position 811 according to SEQ ID NO:18, position 732 according to SEQ ID NO:23, position 971 according to SEQ ID NO:28, positions 919-922 according to SEQ ID NO:14, positions 820-823 according to SEQ ID NO:19, positions 741-744 according to SEQ ID NO:24, positions 980-983 according to SEQ ID NO:29, position 1,410 according to SEQ ID NO:15, position 1,311 according to SEQ ID NO:20, position 1,232 according to SEQ ID NO:25, position 1,471 according to SEQ ID NO:30, position 830 according to SEQ ID NO:100, position 731 according to SEQ ID NO:101, position 652 according to SEQ ID NO:102, or position 891 according to SEQ ID NO:103;

b) extending the primer at least through the position of the nucleotide sequence of the GPR75 mRNA molecule corresponding to: positions 539-545 according to SEQ ID NO:11, positions 440-446 according to SEQ ID NO:16, positions 361-367 according to SEQ ID NO:21, positions 600-606 according to SEQ ID NO:26, position 556 according to SEQ ID NO:12, position 457 according to SEQ ID NO:17, position 378 according to SEQ ID NO:22, position 617 according to SEQ ID NO:27, position 910 according to SEQ ID NO:13, position 811 according to SEQ ID NO:18, position 732 according to SEQ ID NO:23, position 971 according to SEQ ID NO:28, positions 919-922 according to SEQ ID NO:14, positions 820-823 according to SEQ ID NO:19, positions 741-744 according to SEQ ID NO:24, positions 980-983 according to SEQ ID NO:29, position 1,410 according to SEQ ID NO:15, position 1,311 according to SEQ ID NO:20, position 1,232 according to SEQ ID NO:25, position 1,471 according to SEQ ID NO:30, position 830 according to SEQ ID NO:100, position 731 according to SEQ ID NO:101, position 652 according to SEQ ID NO:102, or position 891 according to SEQ ID NO:103; and c) determining whether the extension product of the primer: lacks a CCAGUAG heptanucleotide at positions corresponding to positions 539-545 according to SEQ ID NO:7, lacks a CCAGUAG heptanucleotide at positions corresponding to positions 440-446 according to SEQ ID NO:8, lacks a CCAGUAG heptanucleotide at positions corresponding to positions 361-367 according to SEQ ID NO:9, lacks a CCAGUAG heptanucleotide at positions corresponding to positions 600-606 according to SEQ ID NO:10, comprises an adenine at a position corresponding to position 556 according to SEQ ID NO:12, comprises an adenine at a position corresponding to position 457 according to SEQ ID NO:17, comprises an adenine at a position corresponding to position 378 according to SEQ ID NO:22, comprises an adenine at a position corresponding to position 617 according to SEQ ID NO:27, comprises a uracil at a position corresponding to position 910 according to SEQ ID NO:13, comprises a uracil at a position corresponding to position 811 according to SEQ ID NO:18, comprises a uracil at a position corresponding to position 732 according to SEQ ID NO:23, comprises a uracil at a position corresponding to position 971 according to SEQ ID NO:28, lacks an AAAG tetranucleotide at positions corresponding to positions 919-922 according to SEQ ID NO:7, lacks an AAAG tetranucleotide at positions corresponding to positions 820-823 according to SEQ ID NO:8, lacks an AAAG tetranucleotide at positions corresponding to positions 741-744 according to SEQ ID NO:9, lacks an AAAG tetranucleotide at positions corresponding to positions 980-983 according to SEQ ID NO:10, comprises an insertion of a uracil at a position corresponding to position 1,410 according to SEQ ID NO:15, comprises an insertion of a uracil at a position corresponding to position 1,311 according to SEQ ID NO:20, comprises an insertion of a uracil at a position corresponding to position 1,232 according to SEQ ID NO:25, comprises an insertion of a uracil at a position corresponding to position 1,471 according to SEQ ID NO:30, comprises a guanine at a position corresponding to position 830 according to SEQ ID NO:100, comprises a guanine at a position corresponding to position 731 according to SEQ ID NO:101, comprises a guanine at a position corresponding to position 652 according to SEQ ID NO:102, or comprises a guanine at a position corresponding to position 891 according to SEQ ID NO:103.

Embodiment 25. The method according to any one of embodiments 14 to 19, wherein the detecting step comprises:

a) contacting the biological sample with a primer hybridizing to a portion of the nucleotide sequence of the GPR75 cDNA molecule that is proximate to a position corresponding to: positions 539-545 according to SEQ ID NO:35, positions 440-446 according to SEQ ID NO:40, positions 361-367 according to SEQ ID NO:45, positions 600-606 according to SEQ ID NO:50, position 556 according to SEQ ID NO:36, position 457 according to SEQ ID NO:41, position 378 according to SEQ ID NO:46, position 617 according to SEQ ID NO:51, position 910 according to SEQ ID NO:37, position 811 according to SEQ ID NO:42, position 732 according to SEQ ID NO:47, position 971 according to SEQ ID NO:52, positions 919-922 according to SEQ ID NO:38, positions 820-823 according to SEQ ID NO:43, positions 741-744 according to SEQ ID NO:48, positions 980-983 according to SEQ ID NO:53, position 1,410 according to SEQ ID NO:39, position 1,311 according to SEQ ID NO:44, position 1,232 according to SEQ ID NO:49, position 1,471 according to SEQ ID NO:54, position 830 according to SEQ ID NO:104, position 731 according to SEQ ID NO:105, position 652 according to SEQ ID NO:106, or position 891 according to SEQ ID NO:107;

b) extending the primer at least through the position of the nucleotide sequence of the GPR75 cDNA molecule corresponding to: positions 539-545 according to SEQ ID NO:35, positions 440-446 according to SEQ ID NO:40, positions 361-367 according to SEQ ID NO:45, positions 600-606 according to SEQ ID NO:50, position 556 according to SEQ ID NO:36, position 457 according to SEQ ID NO:41, position 378 according to SEQ ID NO:46, position 617 according to SEQ ID NO:51, position 910 according to SEQ ID NO:37, position 811 according to SEQ ID NO:42, position 732 according to SEQ ID NO:47, position 971 according to SEQ ID NO:52, positions 919-922 according to SEQ ID NO:38, positions 820-823 according to SEQ ID NO:43, positions 741-744 according to SEQ ID NO:48, positions 980-983 according to SEQ ID NO:53, position 1,410 according to SEQ ID NO:39, position 1,311 according to SEQ ID NO:44, position 1,232 according to SEQ ID NO:49, position 1,471 according to SEQ ID NO:54, position 830 according to SEQ ID NO:104, position 731 according to SEQ ID NO:105, position 652 according to SEQ ID NO:106, or position 891 according to SEQ ID NO:107; and c) determining whether the extension product of the primer: lacks a CCAGTAG heptanucleotide at positions corresponding to positions 539-545 according to SEQ ID NO:31, lacks a CCAGTAG heptanucleotide at positions corresponding to positions 440-446 according to SEQ ID NO:32, lacks a CCAGTAG heptanucleotide at positions corresponding to positions 361-367 according to SEQ ID NO:33, lacks a CCAGTAG heptanucleotide at positions corresponding to positions 600-606 according to SEQ ID NO:34, comprises an adenine at a position corresponding to position 556 according to SEQ ID NO:36, comprises an adenine at a position corresponding to position 457 according to SEQ ID NO:41, comprises an adenine at a position corresponding to position 378 according to SEQ ID NO:46, comprises an adenine at a position corresponding to position 617 according to SEQ ID NO:51, comprises a thymine at a position corresponding to position 910 according to SEQ ID NO:37, comprises a thymine at a position corresponding to position 811 according to SEQ ID NO:42, comprises a thymine at a position corresponding to position 732 according to SEQ ID NO:47, comprises a thymine at a position corresponding to position 971 according to SEQ ID NO:52, lacks an AAAG tetranucleotide at positions corresponding to positions 919-922 according to SEQ ID NO:31, lacks an AAAG tetranucleotide at positions corresponding to positions 820-823 according to SEQ ID NO:32, lacks an AAAG tetranucleotide at positions corresponding to positions 741-744 according to SEQ ID NO:33, lacks an AAAG tetranucleotide at positions corresponding to positions 980-983 according to SEQ ID NO:34, comprises an insertion of a thymine at a position corresponding to position 1,410 according to SEQ ID NO:39, comprises an insertion of a thymine at a position corresponding to position 1,311 according to SEQ ID NO:44, comprises an insertion of a thymine at a position corresponding to position 1,232 according to SEQ ID NO:49, comprises an insertion of a thymine at a position corresponding to position 1,471 according to SEQ ID NO:54, comprises a guanine at a position corresponding to position 830 according to SEQ ID NO:104, comprises a guanine at a position corresponding to position 731 according to SEQ ID NO:105, comprises a guanine at a position corresponding to position 652 according to SEQ ID NO:106, or comprises a guanine at a position corresponding to position 891 according to SEQ ID NO:107.

Embodiment 26. The method according to any one of embodiments 20 to 25, wherein the detecting step comprises sequencing the entire nucleic acid molecule.

Embodiment 27. The method according to any one of embodiments 14 to 19, wherein the detecting step comprises:

a) amplifying at least a portion of the nucleic acid molecule that encodes the human GPR75 polypeptide, wherein the portion: lacks a CCAGTAG heptanucleotide at positions corresponding to positions 5,540-5,546 according to SEQ ID NO:1, or the complement thereof; comprises an adenine at a position corresponding to position 5,557 according to SEQ ID NO:3, or the complement thereof; comprises a thymine at a position corresponding to position 5,911 according to SEQ ID NO:4, or the complement thereof; lacks an AAAG tetranucleotide at positions corresponding to positions 5,920-5,923 according to SEQ ID NO:1, or the complement thereof; comprises an insertion of a thymine at a position corresponding to position 6,411 according to SEQ ID NO:6, or the complement thereof; or comprises a guanine at a position corresponding to position 5,831 according to SEQ ID NO:99, or the complement thereof b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGTAG heptanucleotide at positions corresponding to positions 5,540-5,546 according to SEQ ID NO:1, or the complement thereof; comprising an adenine at a position corresponding to position 5,557 according to SEQ ID NO:3, or the complement thereof; comprising a thymine at a position corresponding to position 5,911 according to SEQ ID NO:4, or the complement thereof; lacking an AAAG tetranucleotide at positions corresponding to positions 5,920-5,923 according to SEQ ID NO:1, or the complement thereof; comprising an insertion of a thymine at a position corresponding to position 6,411 according to SEQ ID NO:6, or the complement thereof, or comprises a guanine at a position corresponding to position 5,831 according to SEQ ID NO:99, or the complement thereof; and d) detecting the detectable label.

Embodiment 28. The method according to any one of embodiments 14 to 19, wherein the detecting step comprises:

a) amplifying at least a portion of the nucleic acid molecule that encodes the human GPR75 polypeptide, wherein the portion: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; comprises an adenine at a position corresponding to position 556 according to SEQ ID NO:12, or the complement thereof; comprises an adenine at a position corresponding to position 457 according to SEQ ID NO:17, or the complement thereof; comprises an adenine at a position corresponding to position 378 according to SEQ ID NO:22, or the complement thereof; comprises an adenine at a position corresponding to position 617 according to SEQ ID NO:27, or the complement thereof; comprises a uracil at a position corresponding to position 910 according to SEQ ID NO:13, or the complement thereof; comprises a uracil at a position corresponding to position 811 according to SEQ ID NO:18, or the complement thereof; comprises a uracil at a position corresponding to position 732 according to SEQ ID NO:23, or the complement thereof; comprises a uracil at a position corresponding to position 971 according to SEQ ID NO:28, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; comprises an insertion of a uracil at a position corresponding to position 1,471 according to SEQ ID NO:30, or the complement thereof; comprises a guanine at a position corresponding to position 830 according to SEQ ID NO:100, or the complement thereof; comprises a guanine at a position corresponding to position 731 according to SEQ ID NO:101, or the complement thereof; comprises a guanine at a position corresponding to position 652 according to SEQ ID NO:102, or the complement thereof; or comprises a guanine at a position corresponding to position 891 according to SEQ ID NO:103, or the complement thereof;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; lacking a CCAGUAG heptanucleotide at positions corresponding to positions 600-606 according to SEQ ID NO:10, or the complement thereof; comprising an adenine at a position corresponding to position 556 according to SEQ ID NO:12, or the complement thereof; comprising an adenine at a position corresponding to position 457 according to SEQ ID NO:17, or the complement thereof; comprising an adenine at a position corresponding to position 378 according to SEQ ID NO:22, or the complement thereof; comprising an adenine at a position corresponding to position 617 according to SEQ ID NO:27, or the complement thereof; comprising a uracil at a position corresponding to position 910 according to SEQ ID NO:13, or the complement thereof; comprising a uracil at a position corresponding to position 811 according to SEQ ID NO:18, or the complement thereof; comprising a uracil at a position corresponding to position 732 according to SEQ ID NO:23, or the complement thereof; comprising a uracil at a position corresponding to position 971 according to SEQ ID NO:28, or the complement thereof; lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; lacking an AAAG tetranucleotide at positions corresponding to positions 980-983 according to SEQ ID NO:10, or the complement thereof; comprising an insertion of a uracil at a position corresponding to position 1,410 according to SEQ ID NO:15, or the complement thereof; comprising an insertion of a uracil at a position corresponding to position 1,311 according to SEQ ID NO:20, or the complement thereof; comprising an insertion of a uracil at a position corresponding to position 1,232 according to SEQ ID NO:25, or the complement thereof; comprising an insertion of a uracil at a position corresponding to position 1,471 according to SEQ ID NO:30, or the complement thereof; comprising a guanine at a position corresponding to position 830 according to SEQ ID NO:100, or the complement thereof; comprising a guanine at a position corresponding to position 731 according to SEQ ID NO:101, or the complement thereof; comprising a guanine at a position corresponding to position 652 according to SEQ ID NO:102, or the complement thereof; or comprising a guanine at a position corresponding to position 891 according to SEQ ID NO:103, or the complement thereof; and d) detecting the detectable label.

Embodiment 29. The method according to any one of embodiments 14 to 19, wherein the detecting step comprises:

a) amplifying at least a portion of the nucleic acid molecule that encodes the human GPR75 polypeptide, wherein the portion: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; comprises an adenine at a position corresponding to position 556 according to SEQ ID NO:36, or the complement thereof; comprises an adenine at a position corresponding to position 457 according to SEQ ID NO:41, or the complement thereof; comprises an adenine at a position corresponding to position 378 according to SEQ ID NO:46, or the complement thereof; comprises an adenine at a position corresponding to position 617 according to SEQ ID NO:51, or the complement thereof; comprises a thymine at a position corresponding to position 910 according to SEQ ID NO:37, or the complement thereof; comprises a thymine at a position corresponding to position 811 according to SEQ ID NO:42, or the complement thereof; comprises a thymine at a position corresponding to position 732 according to SEQ ID NO:47, or the complement thereof; comprises a thymine at a position corresponding to position 971 according to SEQ ID NO:52, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, or the complement thereof; comprises an insertion of a thymine at a position corresponding to position 1,471 according to SEQ ID NO:54, or the complement thereof; comprises a guanine at a position corresponding to position 830 according to SEQ ID NO:104, or the complement thereof; comprises a guanine at a position corresponding to position 731 according to SEQ ID NO:105, or the complement thereof; comprises a guanine at a position corresponding to position 652 according to SEQ ID NO:106, or the complement thereof; or comprises a guanine at a position corresponding to position 891 according to SEQ ID NO:107, or the complement thereof;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; lacking a CCAGTAG heptanucleotide at positions corresponding to positions 600-606 according to SEQ ID NO:34, or the complement thereof; comprising an adenine at a position corresponding to position 556 according to SEQ ID NO:36, or the complement thereof; comprising an adenine at a position corresponding to position 457 according to SEQ ID NO:41, or the complement thereof; comprising an adenine at a position corresponding to position 378 according to SEQ ID NO:46, or the complement thereof; comprising an adenine at a position corresponding to position 617 according to SEQ ID NO:51, or the complement thereof; comprising a thymine at a position corresponding to position 910 according to SEQ ID NO:37, or the complement thereof; comprising a thymine at a position corresponding to position 811 according to SEQ ID NO:42, or the complement thereof; comprising a thymine at a position corresponding to position 732 according to SEQ ID NO:47, or the complement thereof; comprising a thymine at a position corresponding to position 971 according to SEQ ID NO:52, or the complement thereof; lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; lacking an AAAG tetranucleotide at positions corresponding to positions 980-983 according to SEQ ID NO:34, or the complement thereof; comprising an insertion of a thymine at a position corresponding to position 1,410 according to SEQ ID NO:39, or the complement thereof; comprising an insertion of a thymine at a position corresponding to position 1,311 according to SEQ ID NO:44, or the complement thereof; comprising an insertion of a thymine at a position corresponding to position 1,232 according to SEQ ID NO:49, or the complement thereof; comprising an insertion of a thymine at a position corresponding to position 1,471 according to SEQ ID NO:54, or the complement thereof; comprising a guanine at a position corresponding to position 830 according to SEQ ID NO:104, or the complement thereof; comprising a guanine at a position corresponding to position 731 according to SEQ ID NO:105, or the complement thereof; comprising a guanine at a position corresponding to position 652 according to SEQ ID NO:106, or the complement thereof; or comprising a guanine at a position corresponding to position 891 according to SEQ ID NO:107, or the complement thereof; and d) detecting the detectable label.

Embodiment 30. The method according to embodiment 29, wherein the nucleic acid molecule in the sample is mRNA and the mRNA is reverse-transcribed into cDNA prior to the amplifying step.

Embodiment 31. The method according to any one of embodiments 14 to 19, wherein the detecting step comprises:

contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGTAG heptanucleotide at positions corresponding to positions 5,540-5,546 according to SEQ ID NO:1, or the complement thereof; comprising an adenine at a position corresponding to position 5,557 according to SEQ ID NO:3, or the complement thereof; comprising a thymine at a position corresponding to position 5,911 according to SEQ ID NO:4, or the complement thereof; lacking an AAAG tetranucleotide at positions corresponding to positions 5,920-5,923 according to SEQ ID NO:1, or the complement thereof; comprising an insertion of a thymine at a position corresponding to position 6,411 according to SEQ ID NO:6, or the complement thereof or comprising a guanine at a position corresponding to position 5,831 according to SEQ ID NO:99, or the complement thereof; and detecting the detectable label.

Embodiment 32. The method according to any one of embodiments 14 to 19, wherein the detecting step comprises:

contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; lacking a CCAGUAG heptanucleotide at positions corresponding to positions 600-606 according to SEQ ID NO:10, or the complement thereof; comprising an adenine at a position corresponding to position 556 according to SEQ ID NO:12, or the complement thereof; comprising an adenine at a position corresponding to position 457 according to SEQ ID NO:17, or the complement thereof; comprising an adenine at a position corresponding to position 378 according to SEQ ID NO:22, or the complement thereof; comprising an adenine at a position corresponding to position 617 according to SEQ ID NO:27, or the complement thereof; comprising a uracil at a position corresponding to position 910 according to SEQ ID NO:13, or the complement thereof; comprising a uracil at a position corresponding to position 811 according to SEQ ID NO:18, or the complement thereof; comprising a uracil at a position corresponding to position 732 according to SEQ ID NO:23, or the complement thereof; comprising a uracil at a position corresponding to position 971 according to SEQ ID NO:28, or the complement thereof; lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; lacking an AAAG tetranucleotide at positions corresponding to positions 980-983 according to SEQ ID NO:10, or the complement thereof; comprising an insertion of a uracil at a position corresponding to position 1,410 according to SEQ ID NO:15, or the complement thereof; comprising an insertion of a uracil at a position corresponding to position 1,311 according to SEQ ID NO:20, or the complement thereof; comprising an insertion of a uracil at a position corresponding to position 1,232 according to SEQ ID NO:25, or the complement thereof; comprising an insertion of a uracil at a position corresponding to position 1,471 according to SEQ ID NO:30, or the complement thereof; comprising a guanine at a position corresponding to position 830 according to SEQ ID NO:100, or the complement thereof; comprising a guanine at a position corresponding to position 731 according to SEQ ID NO:101, or the complement thereof; comprising a guanine at a position corresponding to position 652 according to SEQ ID NO:102, or the complement thereof; or comprising a guanine at a position corresponding to position 891 according to SEQ ID NO:103, or the complement thereof; and detecting the detectable label.

Embodiment 33. The method according to any one of embodiments 14 to 19, wherein the detecting step comprises:

contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; lacking a CCAGTAG heptanucleotide at positions corresponding to positions 600-606 according to SEQ ID NO:34, or the complement thereof; comprising an adenine at a position corresponding to position 556 according to SEQ ID NO:36, or the complement thereof; comprising an adenine at a position corresponding to position 457 according to SEQ ID NO:41, or the complement thereof; comprising an adenine at a position corresponding to position 378 according to SEQ ID NO:46, or the complement thereof; comprising an adenine at a position corresponding to position 617 according to SEQ ID NO:51, or the complement thereof; comprising a thymine at a position corresponding to position 910 according to SEQ ID NO:37, or the complement thereof; comprising a thymine at a position corresponding to position 811 according to SEQ ID NO:42, or the complement thereof; comprising a thymine at a position corresponding to position 732 according to SEQ ID NO:47, or the complement thereof; comprising a thymine at a position corresponding to position 971 according to SEQ ID NO:52, or the complement thereof; lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; lacking an AAAG tetranucleotide at positions corresponding to positions 980-983 according to SEQ ID NO:34, or the complement thereof; comprising an insertion of a thymine at a position corresponding to position 1,410 according to SEQ ID NO:39, or the complement thereof; comprising an insertion of a thymine at a position corresponding to position 1,311 according to SEQ ID NO:44, or the complement thereof; comprising an insertion of a thymine at a position corresponding to position 1,232 according to SEQ ID NO:49, or the complement thereof; or comprising an insertion of a thymine at a position corresponding to position 1,471 according to SEQ ID NO:54, or the complement thereof; comprising a guanine at a position corresponding to position 830 according to SEQ ID NO:104, or the complement thereof; comprising a guanine at a position corresponding to position 731 according to SEQ ID NO:105, or the complement thereof; comprising a guanine at a position corresponding to position 652 according to SEQ ID NO:106, or the complement thereof; or comprising a guanine at a position corresponding to position 891 according to SEQ ID NO:107, or the complement thereof; and detecting the detectable label.

Embodiment 34. A method of treating a subject with a therapeutic agent that treats or inhibits obesity, wherein the subject is obese, the method comprising the steps of:

determining whether the subject has a G-Protein Coupled Receptor 75 (GPR75) missense variant nucleic acid molecule encoding a predicted loss-of-function GPR75 polypeptide by:

obtaining or having obtained a biological sample from the subject; and performing or having performed a sequence analysis on the biological sample to determine if the subject has a genotype comprising the GPR75 missense variant nucleic acid molecule; and administering or continuing to administer the therapeutic agent that treats or inhibits obesity and/or a GPR75 inhibitor in a standard dosage amount to a subject that is GPR75 reference; and administering or continuing to administer the therapeutic agent that treats or inhibits obesity and/or a GPR75 inhibitor in an amount that is the same as or lower than a standard dosage amount to a subject that is heterozygous for a GPR75 missense variant nucleic acid molecule;

wherein the presence of a genotype having the GPR75 missense variant nucleic acid molecule encoding a predicted loss-of-function GPR75 polypeptide indicates the subject has a reduced risk of developing obesity.

Embodiment 35. The method according to embodiment 34, wherein the subject is GPR75 reference, and the subject is administered or continued to be administered the therapeutic agent that treats or inhibits obesity and/or a GPR75 inhibitor in a standard dosage amount.

Embodiment 36. The method according to embodiment 34, wherein the subject is heterozygous for a GPR75 missense variant nucleic acid molecule, and the subject is administered or continued to be administered the therapeutic agent that treats or inhibits obesity and/or a GPR75 inhibitor in an amount that is the same as or lower than a standard dosage amount.

Embodiment 37. The method according to any one of embodiments 34 to 36, wherein the GPR75 missense variant nucleic acid molecule is a nucleic acid molecule encoding Ala110fs, Ala116Thr, Tyr207Cys, Gln234Stop, Arg236fs, or Cys400fs.

Embodiment 38. The method according to embodiment 37, wherein the GPR75 missense variant nucleic acid molecule is:

a genomic nucleic acid molecule having a nucleotide sequence: lacking a CCAGTAG heptanucleotide at positions corresponding to positions 5,540-5,546 according to SEQ ID NO:1, comprising an adenine at a position corresponding to position 5,557 according to SEQ ID NO:3, comprising a thymine at a position corresponding to position 5,911 according to SEQ ID NO:4, lacking an AAAG tetranucleotide at positions corresponding to positions 5,920-5,923 according to SEQ ID NO:1, comprising an insertion of a thymine at a position corresponding to position 6,411 according to SEQ ID NO:6, or comprising a guanine at a position corresponding to position 5,831 according to SEQ ID NO:99;

an mRNA molecule having a nucleotide sequence: lacking a CCAGUAG heptanucleotide at positions corresponding to positions 539-545 according to SEQ ID NO:7, lacking a CCAGUAG heptanucleotide at positions corresponding to positions 440-446 according to SEQ ID NO:8, lacking a CCAGUAG heptanucleotide at positions corresponding to positions 361-367 according to SEQ ID NO:9, lacking a CCAGUAG heptanucleotide at positions corresponding to positions 600-606 according to SEQ ID NO:10; comprising an adenine at a position corresponding to position 556 according to SEQ ID NO:12, comprising an adenine at a position corresponding to position 457 according to SEQ ID NO:17, comprising an adenine at a position corresponding to position 378 according to SEQ ID NO:22, comprising an adenine at a position corresponding to position 617 according to SEQ ID NO:27; comprising a uracil at a position corresponding to position 910 according to SEQ ID NO:13, comprising a uracil at a position corresponding to position 811 according to SEQ ID NO:18, comprising a uracil at a position corresponding to position 732 according to SEQ ID NO:23, comprising a uracil at a position corresponding to position 971 according to SEQ ID NO:28; lacking an AAAG tetranucleotide at positions corresponding to positions 919-922 according to SEQ ID NO:7, lacking an AAAG tetranucleotide at positions corresponding to positions 820-823 according to SEQ ID NO:8, lacking an AAAG tetranucleotide at positions corresponding to positions 741-744 according to SEQ ID NO:9, lacking an AAAG tetranucleotide at positions corresponding to positions 980-983 according to SEQ ID NO:10; comprising an insertion of a uracil at a position corresponding to position 1,410 according to SEQ ID NO:15, comprising an insertion of a uracil at a position corresponding to position 1,311 according to SEQ ID NO:20, comprising an insertion of a uracil at a position corresponding to position 1,232 according to SEQ ID NO:25, or comprising an insertion of a uracil at a position corresponding to position 1,471 according to SEQ ID NO:30, comprising a guanine at a position corresponding to position 830 according to SEQ ID NO:100, comprising a guanine at a position corresponding to position 731 according to SEQ ID NO:101, comprising a guanine at a position corresponding to position 652 according to SEQ ID NO:102, or comprising a guanine at a position corresponding to position 891 according to SEQ ID NO:103; or a cDNA molecule produced from an mRNA molecule, wherein the cDNA molecule has a nucleotide sequence: lacking a CCAGTAG heptanucleotide at positions corresponding to positions 539-545 according to SEQ ID NO:31, lacking a CCAGTAG heptanucleotide at positions corresponding to positions 440-446 according to SEQ ID NO:32, lacking a CCAGTAG heptanucleotide at positions corresponding to positions 361-367 according to SEQ ID NO:33, lacking a CCAGTAG heptanucleotide at positions corresponding to positions 600-606 according to SEQ ID NO:34; comprising an adenine at a position corresponding to position 556 according to SEQ ID NO:36, comprising an adenine at a position corresponding to position 457 according to SEQ ID NO:41, comprising an adenine at a position corresponding to position 378 according to SEQ ID NO:46, comprising an adenine at a position corresponding to position 617 according to SEQ ID NO:51; comprising a thymine at a position corresponding to position 910 according to SEQ ID NO:37, comprising a thymine at a position corresponding to position 811 according to SEQ ID NO:42, comprising a thymine at a position corresponding to position 732 according to SEQ ID NO:47, comprising a thymine at a position corresponding to position 971 according to SEQ ID NO:52; lacking an AAAG tetranucleotide at positions corresponding to positions 919-922 according to SEQ ID NO:31, lacking an AAAG tetranucleotide at positions corresponding to positions 820-823 according to SEQ ID NO:32, lacking an AAAG tetranucleotide at positions corresponding to positions 741-744 according to SEQ ID NO:33, lacking an AAAG tetranucleotide at positions corresponding to positions 980-983 according to SEQ ID NO:34; comprising an insertion of a thymine at a position corresponding to position 1,410 according to SEQ ID NO:39, comprising an insertion of a thymine at a position corresponding to position 1,311 according to SEQ ID NO:44, comprising an insertion of a thymine at a position corresponding to position 1,232 according to SEQ ID NO:49, comprising an insertion of a thymine at a position corresponding to position 1,471 according to SEQ ID NO:54, comprising a guanine at a position corresponding to position 830 according to SEQ ID NO:104, comprising a guanine at a position corresponding to position 731 according to SEQ ID NO:105, comprising a guanine at a position corresponding to position 652 according to SEQ ID NO:106, or comprising a guanine at a position corresponding to position 891 according to SEQ ID NO:107.

Embodiment 39. The method according to any one of embodiments 34 to 38, wherein the sequence analysis comprises sequencing at least a portion of the nucleotide sequence of the GPR75 genomic nucleic acid molecule in the biological sample, wherein the sequenced portion comprises a position corresponding to: positions 5,540-5,546 according to SEQ ID NO:2, or the complement thereof; position 5,557 according to SEQ ID NO:3, or the complement thereof; position 5,911 according to SEQ ID NO:4, or the complement thereof; positions 5,920-5,923 according to SEQ ID NO:5, or the complement thereof; position 6,411 according to SEQ ID NO:6, or the complement thereof; or position 5,831 according to SEQ ID NO:99, or the complement thereof;

wherein when the sequenced portion of the GPR75 genomic nucleic acid molecule in the biological sample: lacks a CCAGTAG heptanucleotide at positions corresponding to positions 5,540-5,546 according to SEQ ID NO:1, comprises an adenine at a position corresponding to position 5,557 according to SEQ ID NO:3, comprises a thymine at a position corresponding to position 5,911 according to SEQ ID NO:4, lacks an AAAG tetranucleotide at positions corresponding to positions 5,920-5,923 according to SEQ ID NO:1, comprises an insertion of a thymine at a position corresponding to position 6,411 according to SEQ ID NO:6, or comprises a guanine at a position corresponding to position 5,831 according to SEQ ID NO:99, then the GPR75 genomic nucleic acid molecule in the biological sample is a GPR75 missense variant genomic nucleic acid molecule.

Embodiment 40. The method according to any one of embodiments 34 to 38, wherein the sequence analysis comprises sequencing at least a portion of the nucleotide sequence of the GPR75 mRNA molecule in the biological sample, wherein the sequenced portion comprises a position corresponding to: positions 539-545 according to SEQ ID NO:11, or the complement thereof; positions 440-446 according to SEQ ID NO:16, or the complement thereof; positions 361-367 according to SEQ ID NO:21, or the complement thereof; positions 600-606 according to SEQ ID NO:26, or the complement thereof; position 556 according to SEQ ID NO:12, or the complement thereof; position 457 according to SEQ ID NO:17, or the complement thereof; position 378 according to SEQ ID NO:22, or the complement thereof; position 617 according to SEQ ID NO:27, or the complement thereof; position 910 according to SEQ ID NO:13, or the complement thereof; position 811 according to SEQ ID NO:18, or the complement thereof; position 732 according to SEQ ID NO:23, or the complement thereof; position 971 according to SEQ ID NO:28, or the complement thereof; positions 919-922 according to SEQ ID NO:14, or the complement thereof; positions 820-823 according to SEQ ID NO:19, or the complement thereof; positions 741-744 according to SEQ ID NO:24, or the complement thereof; positions 980-983 according to SEQ ID NO:29, or the complement thereof; position 1,410 according to SEQ ID NO:15, or the complement thereof; position 1,311 according to SEQ ID NO:20, the complement thereof; position 1,232 according to SEQ ID NO:25, or the complement thereof; or position 1,471 according to SEQ ID NO:30, or the complement thereof; position 830 according to SEQ ID NO:100, or the complement thereof; position 731 according to SEQ ID NO:101, or the complement thereof; position 652 according to SEQ ID NO:102, or the complement thereof; or position 891 according to SEQ ID NO:103, or the complement thereof;

wherein when the sequenced portion of the GPR75 mRNA molecule in the biological sample: lacks a CCAGUAG heptanucleotide at positions corresponding to positions 539-545 according to SEQ ID NO:7; lacks a CCAGUAG heptanucleotide at positions corresponding to positions 440-446 according to SEQ ID NO:8; lacks a CCAGUAG heptanucleotide at positions corresponding to positions 361-367 according to SEQ ID NO:9; lacks a CCAGUAG heptanucleotide at positions corresponding to positions 600-606 according to SEQ ID NO:10; comprises an adenine at a position corresponding to position 556 according to SEQ ID NO:12; comprises an adenine at a position corresponding to position 457 according to SEQ ID NO:17; comprises an adenine at a position corresponding to position 378 according to SEQ ID NO:22; comprises an adenine at a position corresponding to position 617 according to SEQ ID NO:27; comprises a uracil at a position corresponding to position 910 according to SEQ ID NO:13; comprises a uracil at a position corresponding to position 811 according to SEQ ID NO:18; comprises a uracil at a position corresponding to position 732 according to SEQ ID NO:23; comprises a uracil at a position corresponding to position 971 according to SEQ ID NO:28; lacks an AAAG tetranucleotide at positions corresponding to positions 919-922 according to SEQ ID NO:7; lacks an AAAG tetranucleotide at positions corresponding to positions 820-823 according to SEQ ID NO:8; lacks an AAAG tetranucleotide at positions corresponding to positions 741-744 according to SEQ ID NO:9; lacks an AAAG tetranucleotide at positions corresponding to positions 980-983 according to SEQ ID NO:10; comprises an insertion of a uracil at a position corresponding to position 1,410 according to SEQ ID NO:15; comprises an insertion of a uracil at a position corresponding to position 1,311 according to SEQ ID NO:20; comprises an insertion of a uracil at a position corresponding to position 1,232 according to SEQ ID NO:25; comprises an insertion of a uracil at a position corresponding to position 1,471 according to SEQ ID NO:30; comprises a guanine at a position corresponding to position 830 according to SEQ ID NO:100; comprises a guanine at a position corresponding to position 731 according to SEQ ID NO:101; comprises a guanine at a position corresponding to position 652 according to SEQ ID NO:102; or comprises a guanine at a position corresponding to position 891 according to SEQ ID NO:103, then the GPR75 mRNA molecule in the biological sample is a GPR75 missense variant mRNA molecule.

Embodiment 41. The method according to any one of embodiments 34 to 38, wherein the sequence analysis comprises sequencing at least a portion of the nucleotide sequence of the GPR75 cDNA molecule in the biological sample, wherein the sequenced portion comprises a position corresponding to: positions 539-545 according to SEQ ID NO:35, or the complement thereof; positions 440-446 according to SEQ ID NO:40, or the complement thereof; positions 361-367 according to SEQ ID NO:45, or the complement thereof; positions 600-606 according to SEQ ID NO:50, or the complement thereof; position 556 according to SEQ ID NO:36, or the complement thereof; position 457 according to SEQ ID NO:41, or the complement thereof; position 378 according to SEQ ID NO:46, or the complement thereof; position 617 according to SEQ ID NO:51, or the complement thereof; position 910 according to SEQ ID NO:37, or the complement thereof; position 811 according to SEQ ID NO:42, or the complement thereof; position 732 according to SEQ ID NO:47, or the complement thereof; position 971 according to SEQ ID NO:52, or the complement thereof; positions 919-922 according to SEQ ID NO:38, or the complement thereof; positions 820-823 according to SEQ ID NO:43, or the complement thereof; positions 741-744 according to SEQ ID NO:48, or the complement thereof; positions 980-983 according to SEQ ID NO:53, or the complement thereof; position 1,410 according to SEQ ID NO:39, or the complement thereof; position 1,311 according to SEQ ID NO:44, or the complement thereof; position 1,232 according to SEQ ID NO:49, or the complement thereof; position 1,471 according to SEQ ID NO:54, or the complement thereof; position 830 according to SEQ ID NO:104, or the complement thereof; position 731 according to SEQ ID NO:105, or the complement thereof; position 652 according to SEQ ID NO:106, or the complement thereof; or position 891 according to SEQ ID NO:107, or the complement thereof;

wherein when the sequenced portion of the GPR75 cDNA molecule in the biological sample: lacks a CCAGTAG heptanucleotide at positions corresponding to positions 539-545 according to SEQ ID NO:31; lacks a CCAGTAG heptanucleotide at positions corresponding to positions 440-446 according to SEQ ID NO:32; lacks a CCAGTAG heptanucleotide at positions corresponding to positions 361-367 according to SEQ ID NO:33; lacks a CCAGTAG heptanucleotide at positions corresponding to positions 600-606 according to SEQ ID NO:34; comprises an adenine at a position corresponding to position 556 according to SEQ ID NO:36; comprises an adenine at a position corresponding to position 457 according to SEQ ID NO:41; comprises an adenine at a position corresponding to position 378 according to SEQ ID NO:46; comprises an adenine at a position corresponding to position 617 according to SEQ ID NO:51; comprises a thymine at a position corresponding to position 910 according to SEQ ID NO:37; comprises a thymine at a position corresponding to position 811 according to SEQ ID NO:42; comprises a thymine at a position corresponding to position 732 according to SEQ ID NO:47; comprises a thymine at a position corresponding to position 971 according to SEQ ID NO:52; lacks an AAAG tetranucleotide at positions corresponding to positions 919-922 according to SEQ ID NO:31; lacks an AAAG tetranucleotide at positions corresponding to positions 820-823 according to SEQ ID NO:32; lacks an AAAG tetranucleotide at positions corresponding to positions 741-744 according to SEQ ID NO:33; lacks an AAAG tetranucleotide at positions corresponding to positions 980-983 according to SEQ ID NO:34; comprises an insertion of a thymine at a position corresponding to position 1,410 according to SEQ ID NO:39; comprises an insertion of a thymine at a position corresponding to position 1,311 according to SEQ ID NO:44; comprises an insertion of a thymine at a position corresponding to position 1,232 according to SEQ ID NO:49; or comprises an insertion of a thymine at a position corresponding to position 1,471 according to SEQ ID NO:54; comprises a guanine at a position corresponding to position 830 according to SEQ ID NO:104; comprises a guanine at a position corresponding to position 731 according to SEQ ID NO:105; comprises a guanine at a position corresponding to position 652 according to SEQ ID NO:106; or comprises a guanine at a position corresponding to position 891 according to SEQ ID NO:107, then the GPR75 cDNA molecule in the biological sample is a GPR75 missense variant cDNA molecule.

Embodiment 42. The method according to any one of embodiments 34 to 38, wherein the sequence analysis comprises:

a) contacting the biological sample with a primer hybridizing to a portion of the nucleotide sequence of the GPR75 genomic nucleic acid molecule that is proximate to a position corresponding to: positions 5,540-5,546 according to SEQ ID NO:2, position 5,557 according to SEQ ID NO:3, position 5,911 according to SEQ ID NO:4, positions 5,920-5,923 according to SEQ ID NO:5, position 6,411 according to SEQ ID NO:6, or position 5,831 according to SEQ ID NO:99;

b) extending the primer at least through the position of the nucleotide sequence of the GPR75 genomic nucleic acid molecule corresponding to: positions 5,540-5,546 according to SEQ ID NO:2, position 5,557 according to SEQ ID NO:3, position 5,911 according to SEQ ID NO:4, positions 5,920-5,923 according to SEQ ID NO:5, position 6,411 according to SEQ ID NO:6, position 6,411 according to SEQ ID NO:6, or position 5,831 according to SEQ ID NO:99; and c) determining whether the extension product of the primer: lacks a CCAGTAG heptanucleotide at positions corresponding to positions 5,540-5,546 according to SEQ ID NO:1, comprises an adenine at a position corresponding to position 5,557 according to SEQ ID NO:3, comprises a thymine at a position corresponding to position 5,911 according to SEQ ID NO:4, lacks an AAAG tetranucleotide at positions corresponding to positions 5,920-5,923 according to SEQ ID NO:1, comprises an insertion of a thymine at a position corresponding to position 6,411 according to SEQ ID NO:6, or comprises a guanine at a position corresponding to position 5,831 according to SEQ ID NO:99.

Embodiment 43. The method according to any one of embodiments 34 to 38, wherein the sequence analysis comprises:

a) contacting the biological sample with a primer hybridizing to a portion of the nucleotide sequence of the GPR75 mRNA molecule that is proximate to a position corresponding to: positions 539-545 according to SEQ ID NO:11, positions 440-446 according to SEQ ID NO:16, positions 361-367 according to SEQ ID NO:21, positions 600-606 according to SEQ ID NO:26, position 556 according to SEQ ID NO:12, position 457 according to SEQ ID NO:17, position 378 according to SEQ ID NO:22, position 617 according to SEQ ID NO:27, position 910 according to SEQ ID NO:13, position 811 according to SEQ ID NO:18, position 732 according to SEQ ID NO:23, position 971 according to SEQ ID NO:28, positions 919-922 according to SEQ ID NO:14, positions 820-823 according to SEQ ID NO:19, positions 741-744 according to SEQ ID NO:24, positions 980-983 according to SEQ ID NO:29, position 1,410 according to SEQ ID NO:15, position 1,311 according to SEQ ID NO:20, position 1,232 according to SEQ ID NO:25, position 1,471 according to SEQ ID NO:30, position 830 according to SEQ ID NO:100, position 731 according to SEQ ID NO:101, position 652 according to SEQ ID NO:102, or position 891 according to SEQ ID NO:103;

b) extending the primer at least through the position of the nucleotide sequence of the GPR75 mRNA molecule corresponding to: positions 539-545 according to SEQ ID NO:11, positions 440-446 according to SEQ ID NO:16, positions 361-367 according to SEQ ID NO:21, positions 600-606 according to SEQ ID NO:26, position 556 according to SEQ ID NO:12, position 457 according to SEQ ID NO:17, position 378 according to SEQ ID NO:22, position 617 according to SEQ ID NO:27, position 910 according to SEQ ID NO:13, position 811 according to SEQ ID NO:18, position 732 according to SEQ ID NO:23, position 971 according to SEQ ID NO:28, positions 919-922 according to SEQ ID NO:14, positions 820-823 according to SEQ ID NO:19, positions 741-744 according to SEQ ID NO:24, positions 980-983 according to SEQ ID NO:29, position 1,410 according to SEQ ID NO:15, position 1,311 according to SEQ ID NO:20, position 1,232 according to SEQ ID NO:25, position 1,471 according to SEQ ID NO:30, position 830 according to SEQ ID NO:100, position 731 according to SEQ ID NO:101, position 652 according to SEQ ID NO:102, or position 891 according to SEQ ID NO:103; and c) determining whether the extension product of the primer: lacks a CCAGUAG heptanucleotide at positions corresponding to positions 539-545 according to SEQ ID NO:7, lacks a CCAGUAG heptanucleotide at positions corresponding to positions 440-446 according to SEQ ID NO:8, lacks a CCAGUAG heptanucleotide at positions corresponding to positions 361-367 according to SEQ ID NO:9, lacks a CCAGUAG heptanucleotide at positions corresponding to positions 600-606 according to SEQ ID NO:10, comprises an adenine at a position corresponding to position 556 according to SEQ ID NO:12, comprises an adenine at a position corresponding to position 457 according to SEQ ID NO:17, comprises an adenine at a position corresponding to position 378 according to SEQ ID NO:22, comprises an adenine at a position corresponding to position 617 according to SEQ ID NO:27, comprises a uracil at a position corresponding to position 910 according to SEQ ID NO:13, comprises a uracil at a position corresponding to position 811 according to SEQ ID NO:18, comprises a uracil at a position corresponding to position 732 according to SEQ ID NO:23, comprises a uracil at a position corresponding to position 971 according to SEQ ID NO:28, lacks an AAAG tetranucleotide at positions corresponding to positions 919-922 according to SEQ ID NO:7, lacks an AAAG tetranucleotide at positions corresponding to positions 820-823 according to SEQ ID NO:8, lacks an AAAG tetranucleotide at positions corresponding to positions 741-744 according to SEQ ID NO:9, lacks an AAAG tetranucleotide at positions corresponding to positions 980-983 according to SEQ ID NO:10, comprises an insertion of a uracil at a position corresponding to position 1,410 according to SEQ ID NO:15, comprises an insertion of a uracil at a position corresponding to position 1,311 according to SEQ ID NO:20, comprises an insertion of a uracil at a position corresponding to position 1,232 according to SEQ ID NO:25, comprises an insertion of a uracil at a position corresponding to position 1,471 according to SEQ ID NO:30, comprises a guanine at a position corresponding to position 830 according to SEQ ID NO:100, comprises a guanine at a position corresponding to position 731 according to SEQ ID NO:101, comprises a guanine at a position corresponding to position 652 according to SEQ ID NO:102, or comprises a guanine at a position corresponding to position 891 according to SEQ ID NO:103.

Embodiment 44. The method according to any one of embodiments 34 to 38, wherein the sequence analysis comprises:

a) contacting the biological sample with a primer hybridizing to a portion of the nucleotide sequence of the GPR75 cDNA molecule that is proximate to a position corresponding to: positions 539-545 according to SEQ ID NO:35, positions 440-446 according to SEQ ID NO:40, positions 361-367 according to SEQ ID NO:45, positions 600-606 according to SEQ ID NO:50, position 556 according to SEQ ID NO:36, position 457 according to SEQ ID NO:41, position 378 according to SEQ ID NO:46, position 617 according to SEQ ID NO:51, position 910 according to SEQ ID NO:37, position 811 according to SEQ ID NO:42, position 732 according to SEQ ID NO:47, position 971 according to SEQ ID NO:52, positions 919-922 according to SEQ ID NO:38, positions 820-823 according to SEQ ID NO:43, positions 741-744 according to SEQ ID NO:48, positions 980-983 according to SEQ ID NO:53, position 1,410 according to SEQ ID NO:39, position 1,311 according to SEQ ID NO:44, position 1,232 according to SEQ ID NO:49, position 1,471 according to SEQ ID NO:54, position 830 according to SEQ ID NO:104, position 731 according to SEQ ID NO:105, position 652 according to SEQ ID NO:106, or position 891 according to SEQ ID NO:107;

b) extending the primer at least through the position of the nucleotide sequence of the GPR75 cDNA molecule corresponding to: positions 539-545 according to SEQ ID NO:35, positions 440-446 according to SEQ ID NO:40, positions 361-367 according to SEQ ID NO:45, positions 600-606 according to SEQ ID NO:50, position 556 according to SEQ ID NO:36, position 457 according to SEQ ID NO:41, position 378 according to SEQ ID NO:46, position 617 according to SEQ ID NO:51, position 910 according to SEQ ID NO:37, position 811 according to SEQ ID NO:42, position 732 according to SEQ ID NO:47, position 971 according to SEQ ID NO:52, positions 919-922 according to SEQ ID NO:38, positions 820-823 according to SEQ ID NO:43, positions 741-744 according to SEQ ID NO:48, positions 980-983 according to SEQ ID NO:53, position 1,410 according to SEQ ID NO:39, position 1,311 according to SEQ ID NO:44, position 1,232 according to SEQ ID NO:49, position 1,471 according to SEQ ID NO:54, position 830 according to SEQ ID NO:104, position 731 according to SEQ ID NO:105, position 652 according to SEQ ID NO:106, or position 891 according to SEQ ID NO:107; and c) determining whether the extension product of the primer: lacks a CCAGTAG heptanucleotide at positions corresponding to positions 539-545 according to SEQ ID NO:31, lacks a CCAGTAG heptanucleotide at positions corresponding to positions 440-446 according to SEQ ID NO:32, lacks a CCAGTAG heptanucleotide at positions corresponding to positions 361-367 according to SEQ ID NO:33, lacks a CCAGTAG heptanucleotide at positions corresponding to positions 600-606 according to SEQ ID NO:34, comprises an adenine at a position corresponding to position 556 according to SEQ ID NO:36, comprises an adenine at a position corresponding to position 457 according to SEQ ID NO:41, comprises an adenine at a position corresponding to position 378 according to SEQ ID NO:46, comprises an adenine at a position corresponding to position 617 according to SEQ ID NO:51, comprises a thymine at a position corresponding to position 910 according to SEQ ID NO:37, comprises a thymine at a position corresponding to position 811 according to SEQ ID NO:42, comprises a thymine at a position corresponding to position 732 according to SEQ ID NO:47, comprises a thymine at a position corresponding to position 971 according to SEQ ID NO:52, lacks an AAAG tetranucleotide at positions corresponding to positions 919-922 according to SEQ ID NO:31, lacks an AAAG tetranucleotide at positions corresponding to positions 820-823 according to SEQ ID NO:32, lacks an AAAG tetranucleotide at positions corresponding to positions 741-744 according to SEQ ID NO:33, lacks an AAAG tetranucleotide at positions corresponding to positions 980-983 according to SEQ ID NO:34, comprises an insertion of a thymine at a position corresponding to position 1,410 according to SEQ ID NO:39, comprises an insertion of a thymine at a position corresponding to position 1,311 according to SEQ ID NO:44, comprises an insertion of a thymine at a position corresponding to position 1,232 according to SEQ ID NO:49, comprises an insertion of a thymine at a position corresponding to position 1,471 according to SEQ ID NO:54, comprises a guanine at a position corresponding to position 830 according to SEQ ID NO:104, comprises a guanine at a position corresponding to position 731 according to SEQ ID NO:105, comprises a guanine at a position corresponding to position 652 according to SEQ ID NO:106, or comprises a guanine at a position corresponding to position 891 according to SEQ ID NO:107.

Embodiment 45. The method according to any one of embodiments 39 to 44, wherein the sequence analysis comprises sequencing the entire nucleic acid molecule.

Embodiment 46. The method according to any one of embodiments 34 to 38, wherein the sequence analysis comprises:

a) amplifying at least a portion of the nucleic acid molecule that encodes the human GPR75 polypeptide, wherein the portion: lacks a CCAGTAG heptanucleotide at positions corresponding to positions 5,540-5,546 according to SEQ ID NO:1, or the complement thereof; comprises an adenine at a position corresponding to position 5,557 according to SEQ ID NO:3, or the complement thereof; comprises a thymine at a position corresponding to position 5,911 according to SEQ ID NO:4, or the complement thereof; lacks an AAAG tetranucleotide at positions corresponding to positions 5,920-5,923 according to SEQ ID NO:1, or the complement thereof; comprises an insertion of a thymine at a position corresponding to position 6,411 according to SEQ ID NO:6, or the complement thereof; or comprises a guanine at a position corresponding to position 5,831 according to SEQ ID NO:99;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGTAG heptanucleotide at positions corresponding to positions 5,540-5,546 according to SEQ ID NO:1, or the complement thereof; comprising an adenine at a position corresponding to position 5,557 according to SEQ ID NO:3, or the complement thereof; comprising a thymine at a position corresponding to position 5,911 according to SEQ ID NO:4, or the complement thereof; lacking an AAAG tetranucleotide at positions corresponding to positions 5,920-5,923 according to SEQ ID NO:1, or the complement thereof; comprising an insertion of a thymine at a position corresponding to position 6,411 according to SEQ ID NO:6, or the complement thereof; or comprising a guanine at a position corresponding to position 5,831 according to SEQ ID NO:99; and d) detecting the detectable label.

Embodiment 47. The method according to any one of embodiments 34 to 38, wherein the sequence analysis comprises:

a) amplifying at least a portion of the nucleic acid molecule that encodes the human GPR75 polypeptide, wherein the portion: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; comprises an adenine at a position corresponding to position 556 according to SEQ ID NO:12, or the complement thereof; comprises an adenine at a position corresponding to position 457 according to SEQ ID NO:17, or the complement thereof; comprises an adenine at a position corresponding to position 378 according to SEQ ID NO:22, or the complement thereof; comprises an adenine at a position corresponding to position 617 according to SEQ ID NO:27, or the complement thereof; comprises a uracil at a position corresponding to position 910 according to SEQ ID NO:13, or the complement thereof; comprises a uracil at a position corresponding to position 811 according to SEQ ID NO:18, or the complement thereof; comprises a uracil at a position corresponding to position 732 according to SEQ ID NO:23, or the complement thereof; comprises a uracil at a position corresponding to position 971 according to SEQ ID NO:28, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; comprises an insertion of a uracil at a position corresponding to position 1,471 according to SEQ ID NO:30, or the complement thereof; comprises a guanine at a position corresponding to position 830 according to SEQ ID NO:100; comprises a guanine at a position corresponding to position 731 according to SEQ ID NO:101; comprises a guanine at a position corresponding to position 652 according to SEQ ID NO:102; or comprises a guanine at a position corresponding to position 891 according to SEQ ID NO:103, or the complement thereof;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; lacking a CCAGUAG heptanucleotide at positions corresponding to positions 600-606 according to SEQ ID NO:10, or the complement thereof; comprising an adenine at a position corresponding to position 556 according to SEQ ID NO:12, or the complement thereof; comprising an adenine at a position corresponding to position 457 according to SEQ ID NO:17, or the complement thereof; comprising an adenine at a position corresponding to position 378 according to SEQ ID NO:22, or the complement thereof; comprising an adenine at a position corresponding to position 617 according to SEQ ID NO:27, or the complement thereof; comprising a uracil at a position corresponding to position 910 according to SEQ ID NO:13, or the complement thereof; comprising a uracil at a position corresponding to position 811 according to SEQ ID NO:18, or the complement thereof; comprising a uracil at a position corresponding to position 732 according to SEQ ID NO:23, or the complement thereof; comprising a uracil at a position corresponding to position 971 according to SEQ ID NO:28, or the complement thereof; lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; lacking an AAAG tetranucleotide at positions corresponding to positions 980-983 according to SEQ ID NO:10, or the complement thereof; comprising an insertion of a uracil at a position corresponding to position 1,410 according to SEQ ID NO:15, or the complement thereof; comprising an insertion of a uracil at a position corresponding to position 1,311 according to SEQ ID NO:20, or the complement thereof; comprising an insertion of a uracil at a position corresponding to position 1,232 according to SEQ ID NO:25, or the complement thereof; comprising an insertion of a uracil at a position corresponding to position 1,471 according to SEQ ID NO:30, or the complement thereof; comprising a guanine at a position corresponding to position 830 according to SEQ ID NO:100, or the complement thereof; comprising a guanine at a position corresponding to position 731 according to SEQ ID NO:101, or the complement thereof; comprising a guanine at a position corresponding to position 652 according to SEQ ID NO:102, or the complement thereof; or comprising a guanine at a position corresponding to position 891 according to SEQ ID NO:103, or the complement thereof; and d) detecting the detectable label.

Embodiment 48. The method according to any one of embodiments 34 to 38, wherein the sequence analysis comprises:

a) amplifying at least a portion of the nucleic acid molecule that encodes the human GPR75 polypeptide, wherein the portion: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; comprises an adenine at a position corresponding to position 556 according to SEQ ID NO:36, or the complement thereof; comprises an adenine at a position corresponding to position 457 according to SEQ ID NO:41, or the complement thereof; comprises an adenine at a position corresponding to position 378 according to SEQ ID NO:46, or the complement thereof; comprises an adenine at a position corresponding to position 617 according to SEQ ID NO:51, or the complement thereof; comprises a thymine at a position corresponding to position 910 according to SEQ ID NO:37, or the complement thereof; comprises a thymine at a position corresponding to position 811 according to SEQ ID NO:42, or the complement thereof; comprises a thymine at a position corresponding to position 732 according to SEQ ID NO:47, or the complement thereof; comprises a thymine at a position corresponding to position 971 according to SEQ ID NO:52, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, or the complement thereof; comprises an insertion of a thymine at a position corresponding to position 1,471 according to SEQ ID NO:54, or the complement thereof; comprises a guanine at a position corresponding to position 830 according to SEQ ID NO:104, or the complement thereof; comprises a guanine at a position corresponding to position 731 according to SEQ ID NO:105, or the complement thereof; comprises a guanine at a position corresponding to position 652 according to SEQ ID NO:106, or the complement thereof; or comprises a guanine at a position corresponding to position 891 according to SEQ ID NO:107, or the complement thereof;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; lacking a CCAGTAG heptanucleotide at positions corresponding to positions 600-606 according to SEQ ID NO:34, or the complement thereof; comprising an adenine at a position corresponding to position 556 according to SEQ ID NO:36, or the complement thereof; comprising an adenine at a position corresponding to position 457 according to SEQ ID NO:41, or the complement thereof; comprising an adenine at a position corresponding to position 378 according to SEQ ID NO:46, or the complement thereof; comprising an adenine at a position corresponding to position 617 according to SEQ ID NO:51, or the complement thereof; comprising a thymine at a position corresponding to position 910 according to SEQ ID NO:37, or the complement thereof; comprising a thymine at a position corresponding to position 811 according to SEQ ID NO:42, or the complement thereof; comprising a thymine at a position corresponding to position 732 according to SEQ ID NO:47, or the complement thereof; comprising a thymine at a position corresponding to position 971 according to SEQ ID NO:52, or the complement thereof; lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; lacking an AAAG tetranucleotide at positions corresponding to positions 980-983 according to SEQ ID NO:34, or the complement thereof; comprising an insertion of a thymine at a position corresponding to position 1,410 according to SEQ ID NO:39, or the complement thereof; comprising an insertion of a thymine at a position corresponding to position 1,311 according to SEQ ID NO:44, or the complement thereof; comprising an insertion of a thymine at a position corresponding to position 1,232 according to SEQ ID NO:49, or the complement thereof; comprising an insertion of a thymine at a position corresponding to position 1,471 according to SEQ ID NO:54, or the complement thereof; comprising a guanine at a position corresponding to position 830 according to SEQ ID NO:104, or the complement thereof; comprising a guanine at a position corresponding to position 731 according to SEQ ID NO:105, or the complement thereof; comprising a guanine at a position corresponding to position 652 according to SEQ ID NO:106, or the complement thereof; or comprising a guanine at a position corresponding to position 891 according to SEQ ID NO:107, or the complement thereof; and d) detecting the detectable label.

Embodiment 49. The method according to embodiment 48, wherein the nucleic acid molecule in the sample is mRNA and the mRNA is reverse-transcribed into cDNA prior to the amplifying step.

Embodiment 50. The method according to any one of embodiments 34 to 38, wherein the sequence analysis comprises:

contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGTAG heptanucleotide at positions corresponding to positions 5,540-5,546 according to SEQ ID NO:1, or the complement thereof; comprising an adenine at a position corresponding to position 5,557 according to SEQ ID NO:3, or the complement thereof; comprising a thymine at a position corresponding to position 5,911 according to SEQ ID NO:4, or the complement thereof; lacking an AAAG tetranucleotide at positions corresponding to positions 5,920-5,923 according to SEQ ID NO:1, or the complement thereof; comprising an insertion of a thymine at a position corresponding to position 6,411 according to SEQ ID NO:6, or the complement thereof; or comprising a guanine at a position corresponding to position 5,831 according to SEQ ID NO:99, or the complement thereof; and detecting the detectable label.

Embodiment 51. The method according to any one of embodiments 34 to 38, wherein the sequence analysis comprises:

contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; lacking a CCAGUAG heptanucleotide at positions corresponding to positions 600-606 according to SEQ ID NO:10, or the complement thereof; comprising an adenine at a position corresponding to position 556 according to SEQ ID NO:12, or the complement thereof; comprising an adenine at a position corresponding to position 457 according to SEQ ID NO:17, or the complement thereof; comprising an adenine at a position corresponding to position 378 according to SEQ ID NO:22, or the complement thereof; comprising an adenine at a position corresponding to position 617 according to SEQ ID NO:27, or the complement thereof; comprising a uracil at a position corresponding to position 910 according to SEQ ID NO:13, or the complement thereof; comprising a uracil at a position corresponding to position 811 according to SEQ ID NO:18, or the complement thereof; comprising a uracil at a position corresponding to position 732 according to SEQ ID NO:23, or the complement thereof; comprising a uracil at a position corresponding to position 971 according to SEQ ID NO:28, or the complement thereof; lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; lacking an AAAG tetranucleotide at positions corresponding to positions 980-983 according to SEQ ID NO:10, or the complement thereof; comprising an insertion of a uracil at a position corresponding to position 1,410 according to SEQ ID NO:15, or the complement thereof; comprising an insertion of a uracil at a position corresponding to position 1,311 according to SEQ ID NO:20, or the complement thereof; comprising an insertion of a uracil at a position corresponding to position 1,232 according to SEQ ID NO:25, or the complement thereof; comprising an insertion of a uracil at a position corresponding to position 1,471 according to SEQ ID NO:30, or the complement thereof; comprising a guanine at a position corresponding to position 830 according to SEQ ID NO:100, or the complement thereof; comprising a guanine at a position corresponding to position 731 according to SEQ ID NO:101, or the complement thereof; comprising a guanine at a position corresponding to position 652 according to SEQ ID NO:102, or the complement thereof; or comprising a guanine at a position corresponding to position 891 according to SEQ ID NO:103, or the complement thereof; and detecting the detectable label.

Embodiment 52. The method according to any one of embodiments 34 to 38, wherein the sequence analysis comprises:

contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; lacking a CCAGTAG heptanucleotide at positions corresponding to positions 600-606 according to SEQ ID NO:34, or the complement thereof; comprising an adenine at a position corresponding to position 556 according to SEQ ID NO:36, or the complement thereof; comprising an adenine at a position corresponding to position 457 according to SEQ ID NO:41, or the complement thereof; comprising an adenine at a position corresponding to position 378 according to SEQ ID NO:46, or the complement thereof; comprising an adenine at a position corresponding to position 617 according to SEQ ID NO:51, or the complement thereof; comprising a thymine at a position corresponding to position 910 according to SEQ ID NO:37, or the complement thereof; comprising a thymine at a position corresponding to position 811 according to SEQ ID NO:42, or the complement thereof; comprising a thymine at a position corresponding to position 732 according to SEQ ID NO:47, or the complement thereof; comprising a thymine at a position corresponding to position 971 according to SEQ ID NO:52, or the complement thereof; lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; lacking an AAAG tetranucleotide at positions corresponding to positions 980-983 according to SEQ ID NO:34, or the complement thereof; comprising an insertion of a thymine at a position corresponding to position 1,410 according to SEQ ID NO:39, or the complement thereof; comprising an insertion of a thymine at a position corresponding to position 1,311 according to SEQ ID NO:44, or the complement thereof; comprising an insertion of a thymine at a position corresponding to position 1,232 according to SEQ ID NO:49, or the complement thereof; comprising an insertion of a thymine at a position corresponding to position 1,471 according to SEQ ID NO:54, or the complement thereof; comprising a guanine at a position corresponding to position 830 according to SEQ ID NO:104, or the complement thereof; comprising a guanine at a position corresponding to position 731 according to SEQ ID NO:105, or the complement thereof; comprising a guanine at a position corresponding to position 652 according to SEQ ID NO:106, or the complement thereof; or comprising a guanine at a position corresponding to position 891 according to SEQ ID NO:107, or the complement thereof; and detecting the detectable label.

Embodiment 53. The method according to any one of embodiments 34 to 52, wherein the nucleic acid molecule is present within a cell obtained from the subject.

Embodiment 54. The method according to any one of embodiments 34 to 53, wherein the GPR75 inhibitor comprises an antisense nucleic acid molecule, a small interfering RNA (siRNA), or a short hairpin RNA (shRNA) that hybridizes to a GPR75 mRNA.

Embodiment 55. The method according to any one of embodiments 34 to 53, wherein the GPR75 inhibitor comprises a Cas protein and guide RNA (gRNA) that hybridizes to a gRNA recognition sequence within a GPR75 genomic nucleic acid molecule.

Embodiment 56. The method according to embodiment 55, wherein the Cas protein is Cas9 or Cpf1.

Embodiment 57. The method according to embodiment 55 or embodiment 56, wherein the gRNA recognition sequence includes or is proximate to a position corresponding to: position 5,540-5,546 according to SEQ ID NO:1, position 5,557 according to SEQ ID NO:1, position 5,911 according to SEQ ID NO:1, positions 5,920-5,923 according to SEQ ID NO:1, position 6,411 according to SEQ ID NO:1 or position 5,831 according to SEQ ID NO:1.

Embodiment 58. The method according to embodiment 55 or embodiment 56, wherein the gRNA recognition sequence is located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to: position 5,540-5,546 according to SEQ ID NO:1, position 5,557 according to SEQ ID NO:1, position 5,911 according to SEQ ID NO:1, positions 5,920-5,923 according to SEQ ID NO:1, position 6,411 according to SEQ ID NO:1, or position 5,831 according to SEQ ID NO:1.

Embodiment 59. The method according to embodiment 55 or embodiment 56, wherein a Protospacer Adjacent Motif (PAM) sequence is about 2 to 6 nucleotides downstream of the gRNA recognition sequence.

Embodiment 60. The method according to any one of embodiments 55 to 59, wherein the gRNA comprises from about 17 to about 23 nucleotides.

Embodiment 61. The method according to any one of embodiments 55 to 60, wherein the gRNA recognition sequence comprises a nucleotide sequence according to any one of SEQ ID NOS:61-98.

Embodiment 62. A method of identifying a subject having an increased risk for developing obesity, wherein the method comprises:

determining or having determined the presence or absence of a G-Protein Coupled Receptor 75 (GPR75) missense variant nucleic acid molecule encoding a predicted loss-of-function GPR75 polypeptide in a biological sample obtained from the subject;

wherein:

when the subject is GPR75 reference, then the subject has an increased risk for developing obesity; and when the subject is heterozygous for a GPR75 missense variant nucleic acid molecule or homozygous for a GPR75 missense variant nucleic acid molecule, then the subject has a decreased risk for developing obesity.

Embodiment 63. The method according to embodiment 62, wherein the GPR75 missense variant nucleic acid molecule is a nucleic acid molecule encoding Ala110fs, Ala116Thr, Tyr207Cys, Gln234Stop, Arg236fs, or Cys400fs.

Embodiment 64. The method according to embodiment 63, wherein the GPR75 missense variant nucleic acid molecule is:

a genomic nucleic acid molecule having a nucleotide sequence: lacking a CCAGTAG heptanucleotide at positions corresponding to positions 5,540-5,546 according to SEQ ID NO:1, comprising an adenine at a position corresponding to position 5,557 according to SEQ ID NO:3, comprising a thymine at a position corresponding to position 5,911 according to SEQ ID NO:4, lacking an AAAG tetranucleotide at positions corresponding to positions 5,920-5,923 according to SEQ ID NO:1, comprising an insertion of a thymine at a position corresponding to position 6,411 according to SEQ ID NO:6, or comprising a guanine at a position corresponding to position 5,831 according to SEQ ID NO:99;

an mRNA molecule having a nucleotide sequence: lacking a CCAGUAG heptanucleotide at positions corresponding to positions 539-545 according to SEQ ID NO:7, lacking a CCAGUAG heptanucleotide at positions corresponding to positions 440-446 according to SEQ ID NO:8, lacking a CCAGUAG heptanucleotide at positions corresponding to positions 361-367 according to SEQ ID NO:9, lacking a CCAGUAG heptanucleotide at positions corresponding to positions 600-606 according to SEQ ID NO:10; comprising an adenine at a position corresponding to position 556 according to SEQ ID NO:12, comprising an adenine at a position corresponding to position 457 according to SEQ ID NO:17, comprising an adenine at a position corresponding to position 378 according to SEQ ID NO:22, comprising an adenine at a position corresponding to position 617 according to SEQ ID NO:27; comprising a uracil at a position corresponding to position 910 according to SEQ ID NO:13, comprising a uracil at a position corresponding to position 811 according to SEQ ID NO:18, comprising a uracil at a position corresponding to position 732 according to SEQ ID NO:23, comprising a uracil at a position corresponding to position 971 according to SEQ ID NO:28; lacking an AAAG tetranucleotide at positions corresponding to positions 919-922 according to SEQ ID NO:7, lacking an AAAG tetranucleotide at positions corresponding to positions 820-823 according to SEQ ID NO:8, lacking an AAAG tetranucleotide at positions corresponding to positions 741-744 according to SEQ ID NO:9, lacking an AAAG tetranucleotide at positions corresponding to positions 980-983 according to SEQ ID NO:10; comprising an insertion of a uracil at a position corresponding to position 1,410 according to SEQ ID NO:15, comprising an insertion of a uracil at a position corresponding to position 1,311 according to SEQ ID NO:20, comprising an insertion of a uracil at a position corresponding to position 1,232 according to SEQ ID NO:25, comprising an insertion of a uracil at a position corresponding to position 1,471 according to SEQ ID NO:30, comprising a guanine at a position corresponding to position 830 according to SEQ ID NO:100, comprising a guanine at a position corresponding to position 731 according to SEQ ID NO:101, comprising a guanine at a position corresponding to position 652 according to SEQ ID NO:102, or comprising a guanine at a position corresponding to position 891 according to SEQ ID NO:103; or a cDNA molecule produced from an mRNA molecule, wherein the cDNA molecule has a nucleotide sequence: lacking a CCAGTAG heptanucleotide at positions corresponding to positions 539-545 according to SEQ ID NO:31, lacking a CCAGTAG heptanucleotide at positions corresponding to positions 440-446 according to SEQ ID NO:32, lacking a CCAGTAG heptanucleotide at positions corresponding to positions 361-367 according to SEQ ID NO:33, lacking a CCAGTAG heptanucleotide at positions corresponding to positions 600-606 according to SEQ ID NO:34; comprising an adenine at a position corresponding to position 556 according to SEQ ID NO:36, comprising an adenine at a position corresponding to position 457 according to SEQ ID NO:41, comprising an adenine at a position corresponding to position 378 according to SEQ ID NO:46, comprising an adenine at a position corresponding to position 617 according to SEQ ID NO:51; comprising a thymine at a position corresponding to position 910 according to SEQ ID NO:37, comprising a thymine at a position corresponding to position 811 according to SEQ ID NO:42, comprising a thymine at a position corresponding to position 732 according to SEQ ID NO:47, comprising a thymine at a position corresponding to position 971 according to SEQ ID NO:52; lacking an AAAG tetranucleotide at positions corresponding to positions 919-922 according to SEQ ID NO:31, lacking an AAAG tetranucleotide at positions corresponding to positions 820-823 according to SEQ ID NO:32, lacking an AAAG tetranucleotide at positions corresponding to positions 741-744 according to SEQ ID NO:33, lacking an AAAG tetranucleotide at positions corresponding to positions 980-983 according to SEQ ID NO:34; comprising an insertion of a thymine at a position corresponding to position 1,410 according to SEQ ID NO:39, comprising an insertion of a thymine at a position corresponding to position 1,311 according to SEQ ID NO:44, comprising an insertion of a thymine at a position corresponding to position 1,232 according to SEQ ID NO:49, comprising an insertion of a thymine at a position corresponding to position 1,471 according to SEQ ID NO:54, comprising a guanine at a position corresponding to position 830 according to SEQ ID NO:104, comprising a guanine at a position corresponding to position 731 according to SEQ ID NO:105, comprising a guanine at a position corresponding to position 652 according to SEQ ID NO:106, or comprising a guanine at a position corresponding to position 891 according to SEQ ID NO:107.

Embodiment 65. The method according to any one of embodiments 62 to 64, wherein the determining step is carried out in vitro.

Embodiment 66. The method according to any one of embodiments 62 to 64, wherein the determining step comprises sequencing at least a portion of the nucleotide sequence of the GPR75 genomic nucleic acid molecule in the biological sample, wherein the sequenced portion comprises a position corresponding to: positions 5,540-5,546 according to SEQ ID NO:2, or the complement thereof; position 5,557 according to SEQ ID NO:3, or the complement thereof; position 5,911 according to SEQ ID NO:4, or the complement thereof; positions 5,920-5,923 according to SEQ ID NO:5, or the complement thereof; position 6,411 according to SEQ ID NO:6, or the complement thereof; or position 5,831 according to SEQ ID NO:99, or the complement thereof;

wherein when the sequenced portion of the GPR75 genomic nucleic acid molecule in the biological sample: lacks a CCAGTAG heptanucleotide at positions corresponding to positions 5,540-5,546 according to SEQ ID NO:1, comprises an adenine at a position corresponding to position 5,557 according to SEQ ID NO:3, comprises a thymine at a position corresponding to position 5,911 according to SEQ ID NO:4, lacks an AAAG tetranucleotide at positions corresponding to positions 5,920-5,923 according to SEQ ID NO:1, comprises an insertion of a thymine at a position corresponding to position 6,411 according to SEQ ID NO:6, or comprises a guanine at a position corresponding to position 5,831 according to SEQ ID NO:99, then the GPR75 genomic nucleic acid molecule in the biological sample is a GPR75 missense variant genomic nucleic acid molecule.

Embodiment 67. The method according to any one of embodiments 62 to 66, wherein the determining step comprises sequencing at least a portion of the nucleotide sequence of the GPR75 mRNA molecule in the biological sample, wherein the sequenced portion comprises a position corresponding to: positions 539-545 according to SEQ ID NO:11, or the complement thereof; positions 440-446 according to SEQ ID NO:16, or the complement thereof; positions 361-367 according to SEQ ID NO:21, or the complement thereof; positions 600-606 according to SEQ ID NO:26, or the complement thereof; position 556 according to SEQ ID NO:12, or the complement thereof; position 457 according to SEQ ID NO:17, or the complement thereof; position 378 according to SEQ ID NO:22, or the complement thereof; position 617 according to SEQ ID NO:27, or the complement thereof; position 910 according to SEQ ID NO:13, or the complement thereof; position 811 according to SEQ ID NO:18, or the complement thereof; position 732 according to SEQ ID NO:23, or the complement thereof; position 971 according to SEQ ID NO:28, or the complement thereof; positions 919-922 according to SEQ ID NO:14, or the complement thereof; positions 820-823 according to SEQ ID NO:19, or the complement thereof; positions 741-744 according to SEQ ID NO:24, or the complement thereof; positions 980-983 according to SEQ ID NO:29, or the complement thereof; position 1,410 according to SEQ ID NO:15, or the complement thereof; position 1,311 according to SEQ ID NO:20, or the complement thereof; position 1,232 according to SEQ ID NO:25, or the complement thereof; position 1,471 according to SEQ ID NO:30, or the complement thereof; position 830 according to SEQ ID NO:100, or the complement thereof; position 731 according to SEQ ID NO:101, or the complement thereof; position 652 according to SEQ ID NO:102, or the complement thereof; or position 891 according to SEQ ID NO:103, or the complement thereof;

wherein when the sequenced portion of the GPR75 mRNA molecule in the biological sample: lacks a CCAGUAG heptanucleotide at positions corresponding to positions 539-545 according to SEQ ID NO:7; lacks a CCAGUAG heptanucleotide at positions corresponding to positions 440-446 according to SEQ ID NO:8; lacks a CCAGUAG heptanucleotide at positions corresponding to positions 361-367 according to SEQ ID NO:9; lacks a CCAGUAG heptanucleotide at positions corresponding to positions 600-606 according to SEQ ID NO:10; comprises an adenine at a position corresponding to position 556 according to SEQ ID NO:12; comprises an adenine at a position corresponding to position 457 according to SEQ ID NO:17; comprises an adenine at a position corresponding to position 378 according to SEQ ID NO:22; comprises an adenine at a position corresponding to position 617 according to SEQ ID NO:27; comprises a uracil at a position corresponding to position 910 according to SEQ ID NO:13; comprises a uracil at a position corresponding to position 811 according to SEQ ID NO:18; comprises a uracil at a position corresponding to position 732 according to SEQ ID NO:23; comprises a uracil at a position corresponding to position 971 according to SEQ ID NO:28; lacks an AAAG tetranucleotide at positions corresponding to positions 919-922 according to SEQ ID NO:7; lacks an AAAG tetranucleotide at positions corresponding to positions 820-823 according to SEQ ID NO:8; lacks an AAAG tetranucleotide at positions corresponding to positions 741-744 according to SEQ ID NO:9; lacks an AAAG tetranucleotide at positions corresponding to positions 980-983 according to SEQ ID NO:10; comprises an insertion of a uracil at a position corresponding to position 1,410 according to SEQ ID NO:15; comprises an insertion of a uracil at a position corresponding to position 1,311 according to SEQ ID NO:20; comprises an insertion of a uracil at a position corresponding to position 1,232 according to SEQ ID NO:25; comprises an insertion of a uracil at a position corresponding to position 1,471 according to SEQ ID NO:30; comprises a guanine at a position corresponding to position 830 according to SEQ ID NO:100; comprises a guanine at a position corresponding to position 731 according to SEQ ID NO:101; comprises a guanine at a position corresponding to position 652 according to SEQ ID NO:102; or comprises a guanine at a position corresponding to position 891 according to SEQ ID NO:103; then the GPR75 mRNA molecule in the biological sample is a GPR75 missense variant genomic nucleic acid molecule.

Embodiment 68. The method according to any one of embodiments 62 to 66, wherein the determining step comprises sequencing at least a portion of the nucleotide sequence of the GPR75 cDNA molecule in the biological sample, wherein the sequenced portion comprises a position corresponding to: positions 539-545 according to SEQ ID NO:35, or the complement thereof; positions 440-446 according to SEQ ID NO:40, or the complement thereof; positions 361-367 according to SEQ ID NO:45, or the complement thereof; positions 600-606 according to SEQ ID NO:50, or the complement thereof; position 556 according to SEQ ID NO:36, or the complement thereof; position 457 according to SEQ ID NO:41, or the complement thereof; position 378 according to SEQ ID NO:46, or the complement thereof; position 617 according to SEQ ID NO:51, or the complement thereof; position 910 according to SEQ ID NO:37, or the complement thereof; position 811 according to SEQ ID NO:42, or the complement thereof; position 732 according to SEQ ID NO:47, or the complement thereof; position 971 according to SEQ ID NO:52, or the complement thereof; positions 919-922 according to SEQ ID NO:38, or the complement thereof; positions 820-823 according to SEQ ID NO:43, or the complement thereof; positions 741-744 according to SEQ ID NO:48, or the complement thereof; positions 980-983 according to SEQ ID NO:53, or the complement thereof; position 1,410 according to SEQ ID NO:39, or the complement thereof; position 1,311 according to SEQ ID NO:44, or the complement thereof; position 1,232 according to SEQ ID NO:49, or the complement thereof; position 1,471 according to SEQ ID NO:54, or the complement thereof; position 830 according to SEQ ID NO:104, or the complement thereof; position 731 according to SEQ ID NO:105, or the complement thereof; position 652 according to SEQ ID NO:106, or the complement thereof; or position 891 according to SEQ ID NO:107, or the complement thereof;

wherein when the sequenced portion of the GPR75 cDNA molecule in the biological sample: lacks a CCAGTAG heptanucleotide at positions corresponding to positions 539-545 according to SEQ ID NO:31; lacks a CCAGTAG heptanucleotide at positions corresponding to positions 440-446 according to SEQ ID NO:32; lacks a CCAGTAG heptanucleotide at positions corresponding to positions 361-367 according to SEQ ID NO:33; lacks a CCAGTAG heptanucleotide at positions corresponding to positions 600-606 according to SEQ ID NO:34; comprises an adenine at a position corresponding to position 556 according to SEQ ID NO:36; comprises an adenine at a position corresponding to position 457 according to SEQ ID NO:41; comprises an adenine at a position corresponding to position 378 according to SEQ ID NO:46; comprises an adenine at a position corresponding to position 617 according to SEQ ID NO:51; comprises a thymine at a position corresponding to position 910 according to SEQ ID NO:37; comprises a thymine at a position corresponding to position 811 according to SEQ ID NO:42; comprises a thymine at a position corresponding to position 732 according to SEQ ID NO:47; comprises a thymine at a position corresponding to position 971 according to SEQ ID NO:52; lacks an AAAG tetranucleotide at positions corresponding to positions 919-922 according to SEQ ID NO:31; lacks an AAAG tetranucleotide at positions corresponding to positions 820-823 according to SEQ ID NO:32; lacks an AAAG tetranucleotide at positions corresponding to positions 741-744 according to SEQ ID NO:33; lacks an AAAG tetranucleotide at positions corresponding to positions 980-983 according to SEQ ID NO:34; comprises an insertion of a thymine at a position corresponding to position 1,410 according to SEQ ID NO:39; comprises an insertion of a thymine at a position corresponding to position 1,311 according to SEQ ID NO:44; comprises an insertion of a thymine at a position corresponding to position 1,232 according to SEQ ID NO:49; comprises an insertion of a thymine at a position corresponding to position 1,471 according to SEQ ID NO:54; comprises a guanine at a position corresponding to position 830 according to SEQ ID NO:104; comprises a guanine at a position corresponding to position 731 according to SEQ ID NO:105; comprises a guanine at a position corresponding to position 652 according to SEQ ID NO:106; or comprises a guanine at a position corresponding to position 891 according to SEQ ID NO:107; then the GPR75 cDNA molecule in the biological sample is a GPR75 missense variant cDNA molecule.

Embodiment 69. The method according to any one of embodiments 62 to 66, wherein the determining step comprises:

a) contacting the biological sample with a primer hybridizing to a portion of the nucleotide sequence of the GPR75 genomic nucleic acid molecule that is proximate to a position corresponding to: positions 5,540-5,546 according to SEQ ID NO:2, position 5,557 according to SEQ ID NO:3, position 5,911 according to SEQ ID NO:4, positions 5,920-5,923 according to SEQ ID NO:5, position 6,411 according to SEQ ID NO:6, or position corresponding to position 5,831 according to SEQ ID NO:99;

b) extending the primer at least through the position of the nucleotide sequence of the GPR75 genomic nucleic acid molecule corresponding to: positions 5,540-5,546 according to SEQ ID NO:2, position 5,557 according to SEQ ID NO:3, position 5,911 according to SEQ ID NO:4, positions 5,920-5,923 according to SEQ ID NO:5, position 6,411 according to SEQ ID NO:6, or position corresponding to position 5,831 according to SEQ ID NO:99; and c) determining whether the extension product of the primer: lacks a CCAGTAG heptanucleotide at positions corresponding to positions 5,540-5,546 according to SEQ ID NO:1, comprises an adenine at a position corresponding to position 5,557 according to SEQ ID NO:3, comprises a thymine at a position corresponding to position 5,911 according to SEQ ID NO:4, lacks an AAAG tetranucleotide at positions corresponding to positions 5,920-5,923 according to SEQ ID NO:1, comprises an insertion of a thymine at a position corresponding to position 6,411 according to SEQ ID NO:6, or comprises a guanine at a position corresponding to position 5,831 according to SEQ ID NO:99.

Embodiment 70. The method according to any one of embodiments 62 to 66, wherein the determining step comprises:

a) contacting the biological sample with a primer hybridizing to a portion of the nucleotide sequence of the GPR75 mRNA molecule that is proximate to a position corresponding to: positions 539-545 according to SEQ ID NO:11, positions 440-446 according to SEQ ID NO:16, positions 361-367 according to SEQ ID NO:21, positions 600-606 according to SEQ ID NO:26, position 556 according to SEQ ID NO:12, position 457 according to SEQ ID NO:17, position 378 according to SEQ ID NO:22, position 617 according to SEQ ID NO:27, position 910 according to SEQ ID NO:13, position 811 according to SEQ ID NO:18, position 732 according to SEQ ID NO:23, position 971 according to SEQ ID NO:28, positions 919-922 according to SEQ ID NO:14, positions 820-823 according to SEQ ID NO:19, positions 741-744 according to SEQ ID NO:24, positions 980-983 according to SEQ ID NO:29, position 1,410 according to SEQ ID NO:15, position 1,311 according to SEQ ID NO:20, position 1,232 according to SEQ ID NO:25, position 1,471 according to SEQ ID NO:30, position 830 according to SEQ ID NO:100, position 731 according to SEQ ID NO:101, position 652 according to SEQ ID NO:102, or position 891 according to SEQ ID NO:103;

b) extending the primer at least through the position of the nucleotide sequence of the GPR75 mRNA molecule corresponding to: positions 539-545 according to SEQ ID NO:11, positions 440-446 according to SEQ ID NO:16, positions 361-367 according to SEQ ID NO:21, positions 600-606 according to SEQ ID NO:26, position 556 according to SEQ ID NO:12, position 457 according to SEQ ID NO:17, position 378 according to SEQ ID NO:22, position 617 according to SEQ ID NO:27, position 910 according to SEQ ID NO:13, position 811 according to SEQ ID NO:18, position 732 according to SEQ ID NO:23, position 971 according to SEQ ID NO:28, positions 919-922 according to SEQ ID NO:14, positions 820-823 according to SEQ ID NO:19, positions 741-744 according to SEQ ID NO:24, positions 980-983 according to SEQ ID NO:29, position 1,410 according to SEQ ID NO:15, position 1,311 according to SEQ ID NO:20, position 1,232 according to SEQ ID NO:25, position 1,471 according to SEQ ID NO:30, position 830 according to SEQ ID NO:100, position 731 according to SEQ ID NO:101, position 652 according to SEQ ID NO:102, or position 891 according to SEQ ID NO:103; and c) determining whether the extension product of the primer: lacks a CCAGUAG heptanucleotide at positions corresponding to positions 539-545 according to SEQ ID NO:7, lacks a CCAGUAG heptanucleotide at positions corresponding to positions 440-446 according to SEQ ID NO:8, lacks a CCAGUAG heptanucleotide at positions corresponding to positions 361-367 according to SEQ ID NO:9, lacks a CCAGUAG heptanucleotide at positions corresponding to positions 600-606 according to SEQ ID NO:10, comprises an adenine at a position corresponding to position 556 according to SEQ ID NO:12, comprises an adenine at a position corresponding to position 457 according to SEQ ID NO:17, comprises an adenine at a position corresponding to position 378 according to SEQ ID NO:22, comprises an adenine at a position corresponding to position 617 according to SEQ ID NO:27, comprises a uracil at a position corresponding to position 910 according to SEQ ID NO:13, comprises a uracil at a position corresponding to position 811 according to SEQ ID NO:18, comprises a uracil at a position corresponding to position 732 according to SEQ ID NO:23, comprises a uracil at a position corresponding to position 971 according to SEQ ID NO:28, lacks an AAAG tetranucleotide at positions corresponding to positions 919-922 according to SEQ ID NO:7, lacks an AAAG tetranucleotide at positions corresponding to positions 820-823 according to SEQ ID NO:8, lacks an AAAG tetranucleotide at positions corresponding to positions 741-744 according to SEQ ID NO:9, lacks an AAAG tetranucleotide at positions corresponding to positions 980-983 according to SEQ ID NO:10, comprises an insertion of a uracil at a position corresponding to position 1,410 according to SEQ ID NO:15, comprises an insertion of a uracil at a position corresponding to position 1,311 according to SEQ ID NO:20, comprises an insertion of a uracil at a position corresponding to position 1,232 according to SEQ ID NO:25, comprises an insertion of a uracil at a position corresponding to position 1,471 according to SEQ ID NO:30, comprises a guanine at a position corresponding to position 830 according to SEQ ID NO:100, comprises a guanine at a position corresponding to position 731 according to SEQ ID NO:101, comprises a guanine at a position corresponding to position 652 according to SEQ ID NO:102, or comprises a guanine at a position corresponding to position 891 according to SEQ ID NO:103.

Embodiment 71. The method according to any one of embodiments 62 to 66, wherein the determining step comprises:

a) contacting the biological sample with a primer hybridizing to a portion of the nucleotide sequence of the GPR75 cDNA molecule that is proximate to a position corresponding to: positions 539-545 according to SEQ ID NO:35, positions 440-446 according to SEQ ID NO:40, positions 361-367 according to SEQ ID NO:45, positions 600-606 according to SEQ ID NO:50, position 556 according to SEQ ID NO:36, position 457 according to SEQ ID NO:41, position 378 according to SEQ ID NO:46, position 617 according to SEQ ID NO:51, position 910 according to SEQ ID NO:37, position 811 according to SEQ ID NO:42, position 732 according to SEQ ID NO:47, position 971 according to SEQ ID NO:52, positions 919-922 according to SEQ ID NO:38, positions 820-823 according to SEQ ID NO:43, positions 741-744 according to SEQ ID NO:48, positions 980-983 according to SEQ ID NO:53, position 1,410 according to SEQ ID NO:39, position 1,311 according to SEQ ID NO:44, position 1,232 according to SEQ ID NO:49, position 1,471 according to SEQ ID NO:54, position 830 according to SEQ ID NO:104, position 731 according to SEQ ID NO:105, position 652 according to SEQ ID NO:106, or position 891 according to SEQ ID NO:107;

b) extending the primer at least through the position of the nucleotide sequence of the GPR75 cDNA molecule corresponding to: positions 539-545 according to SEQ ID NO:35, positions 440-446 according to SEQ ID NO:40, positions 361-367 according to SEQ ID NO:45, positions 600-606 according to SEQ ID NO:50, position 556 according to SEQ ID NO:36, position 457 according to SEQ ID NO:41, position 378 according to SEQ ID NO:46, position 617 according to SEQ ID NO:51, position 910 according to SEQ ID NO:37, position 811 according to SEQ ID NO:42, position 732 according to SEQ ID NO:47, position 971 according to SEQ ID NO:52, positions 919-922 according to SEQ ID NO:38, positions 820-823 according to SEQ ID NO:43, positions 741-744 according to SEQ ID NO:48, positions 980-983 according to SEQ ID NO:53, position 1,410 according to SEQ ID NO:39, position 1,311 according to SEQ ID NO:44, position 1,232 according to SEQ ID NO:49, position 1,471 according to SEQ ID NO:54, position 830 according to SEQ ID NO:104, position 731 according to SEQ ID NO:105, position 652 according to SEQ ID NO:106, or position 891 according to SEQ ID NO:107, and c) determining whether the extension product of the primer: lacks a CCAGTAG heptanucleotide at positions corresponding to positions 539-545 according to SEQ ID NO:31, lacks a CCAGTAG heptanucleotide at positions corresponding to positions 440-446 according to SEQ ID NO:32, lacks a CCAGTAG heptanucleotide at positions corresponding to positions 361-367 according to SEQ ID NO:33, lacks a CCAGTAG heptanucleotide at positions corresponding to positions 600-606 according to SEQ ID NO:34, comprises an adenine at a position corresponding to position 556 according to SEQ ID NO:36, comprises an adenine at a position corresponding to position 457 according to SEQ ID NO:41, comprises an adenine at a position corresponding to position 378 according to SEQ ID NO:46, comprises an adenine at a position corresponding to position 617 according to SEQ ID NO:51, comprises a thymine at a position corresponding to position 910 according to SEQ ID NO:37, comprises a thymine at a position corresponding to position 811 according to SEQ ID NO:42, comprises a thymine at a position corresponding to position 732 according to SEQ ID NO:47, comprises a thymine at a position corresponding to position 971 according to SEQ ID NO:52, lacks an AAAG tetranucleotide at positions corresponding to positions 919-922 according to SEQ ID NO:31, lacks an AAAG tetranucleotide at positions corresponding to positions 820-823 according to SEQ ID NO:32, lacks an AAAG tetranucleotide at positions corresponding to positions 741-744 according to SEQ ID NO:33, lacks an AAAG tetranucleotide at positions corresponding to positions 980-983 according to SEQ ID NO:34, comprises an insertion of a thymine at a position corresponding to position 1,410 according to SEQ ID NO:39, comprises an insertion of a thymine at a position corresponding to position 1,311 according to SEQ ID NO:44, comprises an insertion of a thymine at a position corresponding to position 1,232 according to SEQ ID NO:49, comprises an insertion of a thymine at a position corresponding to position 1,471 according to SEQ ID NO:54, comprises a guanine at a position corresponding to position 830 according to SEQ ID NO:104, comprises a guanine at a position corresponding to position 731 according to SEQ ID NO:105, comprises a guanine at a position corresponding to position 652 according to SEQ ID NO:106, or comprises a guanine at a position corresponding to position 891 according to SEQ ID NO:107.

Embodiment 72. The method according to any one of embodiments 67 to 71, wherein the determining step comprises sequencing the entire nucleic acid molecule.

Embodiment 73. The method according to any one of embodiments 62 to 66, wherein the determining step comprises:

a) amplifying at least a portion of the nucleic acid molecule that encodes the human GPR75 polypeptide, wherein the portion: lacks a CCAGTAG heptanucleotide at positions corresponding to positions 5,540-5,546 according to SEQ ID NO:1, or the complement thereof; comprises an adenine at a position corresponding to position 5,557 according to SEQ ID NO:3, or the complement thereof; comprises a thymine at a position corresponding to position 5,911 according to SEQ ID NO:4, or the complement thereof; lacks an AAAG tetranucleotide at positions corresponding to positions 5,920-5,923 according to SEQ ID NO:1, or the complement thereof; comprises an insertion of a thymine at a position corresponding to position 6,411 according to SEQ ID NO:6, or the complement thereof; or comprises a guanine at a position corresponding to position 5,831 according to SEQ ID NO:99, or the complement thereof;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGTAG heptanucleotide at positions corresponding to positions 5,540-5,546 according to SEQ ID NO:1, or the complement thereof; comprising an adenine at a position corresponding to position 5,557 according to SEQ ID NO:3, or the complement thereof; comprising a thymine at a position corresponding to position 5,911 according to SEQ ID NO:4, or the complement thereof; lacking an AAAG tetranucleotide at positions corresponding to positions 5,920-5,923 according to SEQ ID NO:1, or the complement thereof; comprising an insertion of a thymine at a position corresponding to position 6,411 according to SEQ ID NO:6, or the complement thereof; or comprising a guanine at a position corresponding to position 5,831 according to SEQ ID NO:99, or the complement thereof; and d) detecting the detectable label.

Embodiment 74. The method according to any one of embodiments 62 to 66, wherein the determining step comprises:

a) amplifying at least a portion of the nucleic acid molecule that encodes the human GPR75 polypeptide, wherein the portion: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; comprises an adenine at a position corresponding to position 556 according to SEQ ID NO:12, or the complement thereof; comprises an adenine at a position corresponding to position 457 according to SEQ ID NO:17, or the complement thereof; comprises an adenine at a position corresponding to position 378 according to SEQ ID NO:22, or the complement thereof; comprises an adenine at a position corresponding to position 617 according to SEQ ID NO:27, or the complement thereof; comprises a uracil at a position corresponding to position 910 according to SEQ ID NO:13, or the complement thereof; comprises a uracil at a position corresponding to position 811 according to SEQ ID NO:18, or the complement thereof; comprises a uracil at a position corresponding to position 732 according to SEQ ID NO:23, or the complement thereof; comprises a uracil at a position corresponding to position 971 according to SEQ ID NO:28, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; comprises an insertion of a uracil at a position corresponding to position 1,471 according to SEQ ID NO:30, or the complement thereof; comprises a guanine at a position corresponding to position 830 according to SEQ ID NO:100, or the complement thereof; comprises a guanine at a position corresponding to position 731 according to SEQ ID NO:101, or the complement thereof; comprises a guanine at a position corresponding to position 652 according to SEQ ID NO:102, or the complement thereof; or comprises a guanine at a position corresponding to position 891 according to SEQ ID NO:103, or the complement thereof;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; lacking a CCAGUAG heptanucleotide at positions corresponding to positions 600-606 according to SEQ ID NO:10, or the complement thereof; comprising an adenine at a position corresponding to position 556 according to SEQ ID NO:12, or the complement thereof; comprising an adenine at a position corresponding to position 457 according to SEQ ID NO:17, or the complement thereof; comprising an adenine at a position corresponding to position 378 according to SEQ ID NO:22, or the complement thereof; comprising an adenine at a position corresponding to position 617 according to SEQ ID NO:27, or the complement thereof; comprising a uracil at a position corresponding to position 910 according to SEQ ID NO:13, or the complement thereof; comprising a uracil at a position corresponding to position 811 according to SEQ ID NO:18, or the complement thereof; comprising a uracil at a position corresponding to position 732 according to SEQ ID NO:23, or the complement thereof; comprising a uracil at a position corresponding to position 971 according to SEQ ID NO:28, or the complement thereof; lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; lacking an AAAG tetranucleotide at positions corresponding to positions 980-983 according to SEQ ID NO:10, or the complement thereof; comprising an insertion of a uracil at a position corresponding to position 1,410 according to SEQ ID NO:15, or the complement thereof; comprising an insertion of a uracil at a position corresponding to position 1,311 according to SEQ ID NO:20, or the complement thereof; comprising an insertion of a uracil at a position corresponding to position 1,232 according to SEQ ID NO:25, or the complement thereof; comprising an insertion of a uracil at a position corresponding to position 1,471 according to SEQ ID NO:30, or the complement thereof; comprising a guanine at a position corresponding to position 830 according to SEQ ID NO:100, or the complement thereof; comprising a guanine at a position corresponding to position 731 according to SEQ ID NO:101, or the complement thereof; comprising a guanine at a position corresponding to position 652 according to SEQ ID NO:102, or the complement thereof; or comprising a guanine at a position corresponding to position 891 according to SEQ ID NO:103, or the complement thereof; and d) detecting the detectable label.

Embodiment 75. The method according to any one of embodiments 62 to 66, wherein the determining step comprises:

a) amplifying at least a portion of the nucleic acid molecule that encodes the human GPR75 polypeptide, wherein the portion: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; comprises an adenine at a position corresponding to position 556 according to SEQ ID NO:36, or the complement thereof; comprises an adenine at a position corresponding to position 457 according to SEQ ID NO:41, or the complement thereof; comprises an adenine at a position corresponding to position 378 according to SEQ ID NO:46, or the complement thereof; comprises an adenine at a position corresponding to position 617 according to SEQ ID NO:51, or the complement thereof; comprises a thymine at a position corresponding to position 910 according to SEQ ID NO:37, or the complement thereof; comprises a thymine at a position corresponding to position 811 according to SEQ ID NO:42, or the complement thereof; comprises a thymine at a position corresponding to position 732 according to SEQ ID NO:47, or the complement thereof; comprises a thymine at a position corresponding to position 971 according to SEQ ID NO:52, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, or the complement thereof; comprises an insertion of a thymine at a position corresponding to position 1,471 according to SEQ ID NO:54, or the complement thereof; comprises a guanine at a position corresponding to position 830 according to SEQ ID NO:104, or the complement thereof; comprises a guanine at a position corresponding to position 731 according to SEQ ID NO:105, or the complement thereof; comprises a guanine at a position corresponding to position 652 according to SEQ ID NO:106, or the complement thereof; or comprises a guanine at a position corresponding to position 891 according to SEQ ID NO:107, or the complement thereof;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; lacking a CCAGTAG heptanucleotide at positions corresponding to positions 600-606 according to SEQ ID NO:34, or the complement thereof; comprising an adenine at a position corresponding to position 556 according to SEQ ID NO:36, or the complement thereof; comprising an adenine at a position corresponding to position 457 according to SEQ ID NO:41, or the complement thereof; comprising an adenine at a position corresponding to position 378 according to SEQ ID NO:46, or the complement thereof; comprising an adenine at a position corresponding to position 617 according to SEQ ID NO:51, or the complement thereof; comprising a thymine at a position corresponding to position 910 according to SEQ ID NO:37, or the complement thereof; comprising a thymine at a position corresponding to position 811 according to SEQ ID NO:42, or the complement thereof; comprising a thymine at a position corresponding to position 732 according to SEQ ID NO:47, or the complement thereof; comprising a thymine at a position corresponding to position 971 according to SEQ ID NO:52, or the complement thereof; lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; lacking an AAAG tetranucleotide at positions corresponding to positions 980-983 according to SEQ ID NO:34, or the complement thereof; comprising an insertion of a thymine at a position corresponding to position 1,410 according to SEQ ID NO:39, or the complement thereof; comprising an insertion of a thymine at a position corresponding to position 1,311 according to SEQ ID NO:44, or the complement thereof; comprising an insertion of a thymine at a position corresponding to position 1,232 according to SEQ ID NO:49, or the complement thereof; comprising an insertion of a thymine at a position corresponding to position 1,471 according to SEQ ID NO:54, or the complement thereof; comprising a guanine at a position corresponding to position 830 according to SEQ ID NO:104, or the complement thereof; comprising a guanine at a position corresponding to position 731 according to SEQ ID NO:105, or the complement thereof; comprising a guanine at a position corresponding to position 652 according to SEQ ID NO:106, or the complement thereof; or comprising a guanine at a position corresponding to position 891 according to SEQ ID NO:107, or the complement thereof; and d) detecting the detectable label.

Embodiment 76. The method according to embodiment 75, wherein the nucleic acid molecule in the sample is mRNA and the mRNA is reverse-transcribed into cDNA prior to the amplifying step.

Embodiment 77. The method according to any one of embodiments 62 to 66, wherein the detecting step comprises:

contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGTAG heptanucleotide at positions corresponding to positions 5,540-5,546 according to SEQ ID NO:1, or the complement thereof; comprising an adenine at a position corresponding to position 5,557 according to SEQ ID NO:3, or the complement thereof; comprising a thymine at a position corresponding to position 5,911 according to SEQ ID NO:4, or the complement thereof; lacking an AAAG tetranucleotide at positions corresponding to positions 5,920-5,923 according to SEQ ID NO:1, or the complement thereof; comprising an insertion of a thymine at a position corresponding to position 6,411 according to SEQ ID NO:6, or the complement thereof; or comprising a guanine at a position corresponding to position 5,831 according to SEQ ID NO:99, or the complement thereof; and detecting the detectable label.

Embodiment 78. The method according to any one of embodiments 62 to 66, wherein the detecting step comprises:

contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; lacking a CCAGUAG heptanucleotide at positions corresponding to positions 600-606 according to SEQ ID NO:10, or the complement thereof; comprising an adenine at a position corresponding to position 556 according to SEQ ID NO:12, or the complement thereof; comprising an adenine at a position corresponding to position 457 according to SEQ ID NO:17, or the complement thereof; comprising an adenine at a position corresponding to position 378 according to SEQ ID NO:22, or the complement thereof; comprising an adenine at a position corresponding to position 617 according to SEQ ID NO:27, or the complement thereof; comprising a uracil at a position corresponding to position 910 according to SEQ ID NO:13, or the complement thereof; comprising a uracil at a position corresponding to position 811 according to SEQ ID NO:18, or the complement thereof; comprising a uracil at a position corresponding to position 732 according to SEQ ID NO:23, or the complement thereof; comprising a uracil at a position corresponding to position 971 according to SEQ ID NO:28, or the complement thereof; lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; lacking an AAAG tetranucleotide at positions corresponding to positions 980-983 according to SEQ ID NO:10, or the complement thereof; comprising an insertion of a uracil at a position corresponding to position 1,410 according to SEQ ID NO:15, or the complement thereof; comprising an insertion of a uracil at a position corresponding to position 1,311 according to SEQ ID NO:20, or the complement thereof; comprising an insertion of a uracil at a position corresponding to position 1,232 according to SEQ ID NO:25, or the complement thereof; or comprising an insertion of a uracil at a position corresponding to position 1,471 according to SEQ ID NO:30, or the complement thereof; comprising a guanine at a position corresponding to position 830 according to SEQ ID NO:100, or the complement thereof; comprising a guanine at a position corresponding to position 731 according to SEQ ID NO:101, or the complement thereof; comprising a guanine at a position corresponding to position 652 according to SEQ ID NO:102, or the complement thereof; or comprising a guanine at a position corresponding to position 891 according to SEQ ID NO:103, or the complement thereof; and detecting the detectable label.

Embodiment 79. The method according to any one of embodiments 62 to 66, wherein the detecting step comprises:

contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; lacking a CCAGTAG heptanucleotide at positions corresponding to positions 600-606 according to SEQ ID NO:34, or the complement thereof; comprising an adenine at a position corresponding to position 556 according to SEQ ID NO:36, or the complement thereof; comprising an adenine at a position corresponding to position 457 according to SEQ ID NO:41, or the complement thereof; comprising an adenine at a position corresponding to position 378 according to SEQ ID NO:46, or the complement thereof; comprising an adenine at a position corresponding to position 617 according to SEQ ID NO:51, or the complement thereof; comprising a thymine at a position corresponding to position 910 according to SEQ ID NO:37, or the complement thereof; comprising a thymine at a position corresponding to position 811 according to SEQ ID NO:42, or the complement thereof; comprising a thymine at a position corresponding to position 732 according to SEQ ID NO:47, or the complement thereof; comprising a thymine at a position corresponding to position 971 according to SEQ ID NO:52, or the complement thereof; lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; lacking an AAAG tetranucleotide at positions corresponding to positions 980-983 according to SEQ ID NO:34, or the complement thereof; comprising an insertion of a thymine at a position corresponding to position 1,410 according to SEQ ID NO:39, or the complement thereof; comprising an insertion of a thymine at a position corresponding to position 1,311 according to SEQ ID NO:44, or the complement thereof; comprising an insertion of a thymine at a position corresponding to position 1,232 according to SEQ ID NO:49, or the complement thereof; comprising an insertion of a thymine at a position corresponding to position 1,471 according to SEQ ID NO:54, or the complement thereof;

comprising a guanine at a position corresponding to position 830 according to SEQ ID NO:104, or the complement thereof; comprising a guanine at a position corresponding to position 731 according to SEQ ID NO:105, or the complement thereof; comprising a guanine at a position corresponding to position 652 according to SEQ ID NO:106, or the complement thereof; or comprising a guanine at a position corresponding to position 891 according to SEQ ID NO:107, or the complement thereof; and detecting the detectable label.

Embodiment 80. The method according to any one of embodiments 62 to 79, wherein the subject is GPR75 reference, and the subject is administered a therapeutic agent that treats or inhibits obesity and/or a GPR75 inhibitor in a standard dosage amount.

Embodiment 81. The method according to any one of embodiments 62 to 79, wherein the subject is heterozygous for a GPR75 missense variant nucleic acid molecule, and the subject is administered a therapeutic agent that treats or inhibits obesity and/or a GPR75 inhibitor in an amount that is the same as or lower than a standard dosage amount.

Embodiment 82. A method of detecting a human G-Protein Coupled Receptor 75 (GPR75) variant nucleic acid molecule in a subject comprising assaying a sample obtained from the subject to determine whether a nucleic acid molecule in the sample is:

a genomic nucleic acid molecule comprising a nucleotide sequence: lacking a CCAGTAG heptanucleotide at positions corresponding to positions 5,540-5,546 according to SEQ ID NO:1, or the complement thereof; comprising an adenine at a position corresponding to position 5,557 according to SEQ ID NO:3, or the complement thereof; comprising a thymine at a position corresponding to position 5,911 according to SEQ ID NO:4, or the complement thereof; lacking an AAAG tetranucleotide at positions corresponding to positions 5,920-5,923 according to SEQ ID NO:1, or the complement thereof; comprising an insertion of a thymine at a position corresponding to position 6,411 according to SEQ ID NO:6, or the complement thereof; or comprising a guanine at a position corresponding to position 5,831 according to SEQ ID NO:99, or the complement thereof;

an mRNA molecule having a nucleotide sequence: lacking a CCAGUAG heptanucleotide at positions corresponding to positions 539-545 according to SEQ ID NO:7 or the complement thereof, lacking a CCAGUAG heptanucleotide at positions corresponding to positions 440-446 according to SEQ ID NO:8 or the complement thereof, lacking a CCAGUAG heptanucleotide at positions corresponding to positions 361-367 according to SEQ ID NO:9 or the complement thereof, lacking a CCAGUAG heptanucleotide at positions corresponding to positions 600-606 according to SEQ ID NO:10 or the complement thereof; comprising an adenine at a position corresponding to position 556 according to SEQ ID NO:12 or the complement thereof, comprising an adenine at a position corresponding to position 457 according to SEQ ID NO:17 or the complement thereof, comprising an adenine at a position corresponding to position 378 according to SEQ ID NO:22 or the complement thereof, comprising an adenine at a position corresponding to position 617 according to SEQ ID NO:27 or the complement thereof; comprising a uracil at a position corresponding to position 910 according to SEQ ID NO:13 or the complement thereof, comprising a uracil at a position corresponding to position 811 according to SEQ ID NO:18 or the complement thereof, comprising a uracil at a position corresponding to position 732 according to SEQ ID NO:23 or the complement thereof, comprising a uracil at a position corresponding to position 971 according to SEQ ID NO:28 or the complement thereof; lacking an AAAG tetranucleotide at positions corresponding to positions 919-922 according to SEQ ID NO:7 or the complement thereof, lacking an AAAG tetranucleotide at positions corresponding to positions 820-823 according to SEQ ID NO:8 or the complement thereof, lacking an AAAG tetranucleotide at positions corresponding to positions 741-744 according to SEQ ID NO:9 or the complement thereof, lacking an AAAG tetranucleotide at positions corresponding to positions 980-983 according to SEQ ID NO:10 or the complement thereof; comprising an insertion of a uracil at a position corresponding to position 1,410 according to SEQ ID NO:15 or the complement thereof, comprising an insertion of a uracil at a position corresponding to position 1,311 according to SEQ ID NO:20 or the complement thereof, comprising an insertion of a uracil at a position corresponding to position 1,232 according to SEQ ID NO:25 or the complement thereof, comprising an insertion of a uracil at a position corresponding to position 1,471 according to SEQ ID NO:30 or the complement thereof, comprising a guanine at a position corresponding to position 830 according to SEQ ID NO:100, or the complement thereof, comprising a guanine at a position corresponding to position 731 according to SEQ ID NO:101, or the complement thereof, comprising a guanine at a position corresponding to position 652 according to SEQ ID NO:102, or the complement thereof, or comprising a guanine at a position corresponding to position 891 according to SEQ ID NO:103, or the complement thereof; or a cDNA molecule produced from an mRNA molecule, wherein the cDNA molecule has a nucleotide sequence: lacking a CCAGTAG heptanucleotide at positions corresponding to positions 539-545 according to SEQ ID NO:31 or the complement thereof, lacking a CCAGTAG heptanucleotide at positions corresponding to positions 440-446 according to SEQ ID NO:32 or the complement thereof, lacking a CCAGTAG heptanucleotide at positions corresponding to positions 361-367 according to SEQ ID NO:33 or the complement thereof, lacking a CCAGTAG heptanucleotide at positions corresponding to positions 600-606 according to SEQ ID NO:34 or the complement thereof; comprising an adenine at a position corresponding to position 556 according to SEQ ID NO:36 or the complement thereof, comprising an adenine at a position corresponding to position 457 according to SEQ ID NO:41 or the complement thereof, comprising an adenine at a position corresponding to position 378 according to SEQ ID NO:46 or the complement thereof, comprising an adenine at a position corresponding to position 617 according to SEQ ID NO:51 or the complement thereof; comprising a thymine at a position corresponding to position 910 according to SEQ ID NO:37 or the complement thereof, comprising a thymine at a position corresponding to position 811 according to SEQ ID NO:42 or the complement thereof, comprising a thymine at a position corresponding to position 732 according to SEQ ID NO:47 or the complement thereof, comprising a thymine at a position corresponding to position 971 according to SEQ ID NO:52 or the complement thereof; lacking an AAAG tetranucleotide at positions corresponding to positions 919-922 according to SEQ ID NO:31 or the complement thereof, lacking an AAAG tetranucleotide at positions corresponding to positions 820-823 according to SEQ ID NO:32 or the complement thereof, lacking an AAAG tetranucleotide at positions corresponding to positions 741-744 according to SEQ ID NO:33 or the complement thereof, lacking an AAAG tetranucleotide at positions corresponding to positions 980-983 according to SEQ ID NO:34 or the complement thereof; comprising an insertion of a thymine at a position corresponding to position 1,410 according to SEQ ID NO:39 or the complement thereof, comprising an insertion of a thymine at a position corresponding to position 1,311 according to SEQ ID NO:44 or the complement thereof, comprising an insertion of a thymine at a position corresponding to position 1,232 according to SEQ ID NO:49 or the complement thereof, comprising an insertion of a thymine at a position corresponding to position 1,471 according to SEQ ID NO:54 or the complement thereof, comprising a guanine at a position corresponding to position 830 according to SEQ ID NO:104 or the complement thereof, comprising a guanine at a position corresponding to position 731 according to SEQ ID NO:105 or the complement thereof, comprising a guanine at a position corresponding to position 652 according to SEQ ID NO:106 or the complement thereof, or comprising a guanine at a position corresponding to position 891 according to SEQ ID NO:107, or the complement thereof.

Embodiment 83. The method according to embodiment 82, wherein the method is an in vitro method.

Embodiment 84. The method according to embodiment 82 or embodiment 83, wherein the assay comprises sequencing at least a portion of the nucleic acid molecule, wherein the sequenced portion: lacks a CCAGTAG heptanucleotide at positions corresponding to positions 5,540-5,546 according to SEQ ID NO:1, or the complement thereof; comprises an adenine at a position corresponding to position 5,557 according to SEQ ID NO:3, or the complement thereof; comprises a thymine at a position corresponding to position 5,911 according to SEQ ID NO:4, or the complement thereof; lacks an AAAG tetranucleotide at positions corresponding to positions 5,920-5,923 according to SEQ ID NO:1, or the complement thereof; comprises an insertion of a thymine at a position corresponding to position 6,411 according to SEQ ID NO:6, or the complement thereof; or comprises a guanine at a position corresponding to position 5,831 according to SEQ ID NO:99, or the complement thereof.

Embodiment 85. The method according to embodiment 82 or embodiment 83, wherein the assay comprises sequencing at least a portion of the nucleic acid molecule, wherein the sequenced portion: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; comprises an adenine at a position corresponding to position 556 according to SEQ ID NO:12, or the complement thereof; comprises an adenine at a position corresponding to position 457 according to SEQ ID NO:17, or the complement thereof; comprises an adenine at a position corresponding to position 378 according to SEQ ID NO:22, or the complement thereof; comprises an adenine at a position corresponding to position 617 according to SEQ ID NO:27, or the complement thereof; comprises a uracil at a position corresponding to position 910 according to SEQ ID NO:13, or the complement thereof; comprises a uracil at a position corresponding to position 811 according to SEQ ID NO:18, or the complement thereof; comprises a uracil at a position corresponding to position 732 according to SEQ ID NO:23, or the complement thereof; comprises a uracil at a position corresponding to position 971 according to SEQ ID NO:28, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; comprises an insertion of a uracil at a position corresponding to position 1,471 according to SEQ ID NO:30, or the complement thereof; comprises a guanine at a position corresponding to position 830 according to SEQ ID NO:100, or the complement thereof; comprises a guanine at a position corresponding to position 731 according to SEQ ID NO:101, or the complement thereof; comprises a guanine at a position corresponding to position 652 according to SEQ ID NO:102, or the complement thereof; or comprises a guanine at a position corresponding to position 891 according to SEQ ID NO:103, or the complement thereof.

Embodiment 86. The method according to embodiment 82 or embodiment 83, wherein the assay comprises sequencing at least a portion of the nucleic acid molecule, wherein the sequenced portion: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; comprises an adenine at a position corresponding to position 556 according to SEQ ID NO:36, or the complement thereof; comprises an adenine at a position corresponding to position 457 according to SEQ ID NO:41, or the complement thereof; comprises an adenine at a position corresponding to position 378 according to SEQ ID NO:46, or the complement thereof; comprises an adenine at a position corresponding to position 617 according to SEQ ID NO:51, or the complement thereof; comprises a thymine at a position corresponding to position 910 according to SEQ ID NO:37, or the complement thereof; comprises a thymine at a position corresponding to position 811 according to SEQ ID NO:42, or the complement thereof; comprises a thymine at a position corresponding to position 732 according to SEQ ID NO:47, or the complement thereof; comprises a thymine at a position corresponding to position 971 according to SEQ ID NO:52, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, the complement thereof; comprises an insertion of a thymine at a position corresponding to position 1,471 according to SEQ ID NO:54, or the complement thereof; comprises a guanine at a position corresponding to position 830 according to SEQ ID NO:104, or the complement thereof; comprises a guanine at a position corresponding to position 731 according to SEQ ID NO:105, or the complement thereof; comprises a guanine at a position corresponding to position 652 according to SEQ ID NO:106, or the complement thereof; or comprises a guanine at a position corresponding to position 891 according to SEQ ID NO:107, or the complement thereof.

Embodiment 87. The method according to embodiment 82 or embodiment 83, wherein the assay comprises:

a) contacting the sample with a primer hybridizing to a portion of the nucleotide sequence of the GPR75 genomic nucleic acid molecule that is proximate to a position corresponding to: positions 5,540-5,546 according to SEQ ID NO:2, position 5,557 according to SEQ ID NO:3, position 5,911 according to SEQ ID NO:4, positions 5,920-5,923 according to SEQ ID NO:5, position 6,411 according to SEQ ID NO:6, or position 5,831 according to SEQ ID NO:99;

b) extending the primer at least through the position of the nucleotide sequence of the GPR75 genomic nucleic acid molecule corresponding to: positions 5,540-5,546 according to SEQ ID NO:2, position 5,557 according to SEQ ID NO:3, position 5,911 according to SEQ ID NO:4, positions 5,920-5,923 according to SEQ ID NO:5, position 6,411 according to SEQ ID NO:6, or position 5,831 according to SEQ ID NO:99; and c) determining whether the extension product of the primer: lacks a CCAGTAG heptanucleotide at positions corresponding to positions 5,540-5,546 according to SEQ ID NO:1, comprises an adenine at a position corresponding to position 5,557 according to SEQ ID NO:3, comprises a thymine at a position corresponding to position 5,911 according to SEQ ID NO:4, lacks an AAAG tetranucleotide at positions corresponding to positions 5,920-5,923 according to SEQ ID NO:1, comprises an insertion of a thymine at a position corresponding to position 6,411 according to SEQ ID NO:6, or comprises guanine at a position corresponding to position 5,831 according to SEQ ID NO:99.

Embodiment 88. The method according to embodiment 82 or embodiment 83, wherein the assay comprises:

a) contacting the sample with a primer hybridizing to a portion of the nucleotide sequence of the GPR75 mRNA molecule that is proximate to a position corresponding to: positions 539-545 according to SEQ ID NO:11, positions 440-446 according to SEQ ID NO:16, positions 361-367 according to SEQ ID NO:21, positions 600-606 according to SEQ ID NO:26, position 556 according to SEQ ID NO:12, position 457 according to SEQ ID NO:17, position 378 according to SEQ ID NO:22, position 617 according to SEQ ID NO:27, position 910 according to SEQ ID NO:13, position 811 according to SEQ ID NO:18, position 732 according to SEQ ID NO:23, position 971 according to SEQ ID NO:28, positions 919-922 according to SEQ ID NO:14, positions 820-823 according to SEQ ID NO:19, positions 741-744 according to SEQ ID NO:24, positions 980-983 according to SEQ ID NO:29, position 1,410 according to SEQ ID NO:15, position 1,311 according to SEQ ID NO:20, position 1,232 according to SEQ ID NO:25, position 1,471 according to SEQ ID NO:30, position 830 according to SEQ ID NO:100, position 731 according to SEQ ID NO:101, position 652 according to SEQ ID NO:102, or position 891 according to SEQ ID NO:103;

b) extending the primer at least through the position of the nucleotide sequence of the GPR75 mRNA molecule corresponding to: positions 539-545 according to SEQ ID NO:11, positions 440-446 according to SEQ ID NO:16, positions 361-367 according to SEQ ID NO:21, positions 600-606 according to SEQ ID NO:26, position 556 according to SEQ ID NO:12, position 457 according to SEQ ID NO:17, position 378 according to SEQ ID NO:22, position 617 according to SEQ ID NO:27, position 910 according to SEQ ID NO:13, position 811 according to SEQ ID NO:18, position 732 according to SEQ ID NO:23, position 971 according to SEQ ID NO:28, positions 919-922 according to SEQ ID NO:14, positions 820-823 according to SEQ ID NO:19, positions 741-744 according to SEQ ID NO:24, positions 980-983 according to SEQ ID NO:29, position 1,410 according to SEQ ID NO:15, position 1,311 according to SEQ ID NO:20, position 1,232 according to SEQ ID NO:25, position 1,471 according to SEQ ID NO:30, position 830 according to SEQ ID NO:100, position 731 according to SEQ ID NO:101, position 652 according to SEQ ID NO:102, or position 891 according to SEQ ID NO:103; and c) determining whether the extension product of the primer: lacks a CCAGUAG heptanucleotide at positions corresponding to positions 539-545 according to SEQ ID NO:7, lacks a CCAGUAG heptanucleotide at positions corresponding to positions 440-446 according to SEQ ID NO:8, lacks a CCAGUAG heptanucleotide at positions corresponding to positions 361-367 according to SEQ ID NO:9, lacks a CCAGUAG heptanucleotide at positions corresponding to positions 600-606 according to SEQ ID NO:10, comprises an adenine at a position corresponding to position 556 according to SEQ ID NO:12, comprises an adenine at a position corresponding to position 457 according to SEQ ID NO:17, comprises an adenine at a position corresponding to position 378 according to SEQ ID NO:22, comprises an adenine at a position corresponding to position 617 according to SEQ ID NO:27, comprises a uracil at a position corresponding to position 910 according to SEQ ID NO:13, comprises a uracil at a position corresponding to position 811 according to SEQ ID NO:18, comprises a uracil at a position corresponding to position 732 according to SEQ ID NO:23, comprises a uracil at a position corresponding to position 971 according to SEQ ID NO:28, lacks an AAAG tetranucleotide at positions corresponding to positions 919-922 according to SEQ ID NO:7, lacks an AAAG tetranucleotide at positions corresponding to positions 820-823 according to SEQ ID NO:8, lacks an AAAG tetranucleotide at positions corresponding to positions 741-744 according to SEQ ID NO:9, lacks an AAAG tetranucleotide at positions corresponding to positions 980-983 according to SEQ ID NO:10, comprises an insertion of a uracil at a position corresponding to position 1,410 according to SEQ ID NO:15, comprises an insertion of a uracil at a position corresponding to position 1,311 according to SEQ ID NO:20, comprises an insertion of a uracil at a position corresponding to position 1,232 according to SEQ ID NO:25, comprises an insertion of a uracil at a position corresponding to position 1,471 according to SEQ ID NO:30, comprises a guanine at a position corresponding to position 830 according to SEQ ID NO:100, comprises a guanine at a position corresponding to position 731 according to SEQ ID NO:101, comprises a guanine at a position corresponding to position 652 according to SEQ ID NO:102, or comprises a guanine at a position corresponding to position 891 according to SEQ ID NO:103.

Embodiment 89. The method according to embodiment 82 or embodiment 83, wherein the assay comprises:

a) contacting the sample with a primer hybridizing to a portion of the nucleotide sequence of the GPR75 cDNA molecule that is proximate to a position corresponding to: positions 539-545 according to SEQ ID NO:35, positions 440-446 according to SEQ ID NO:40, positions 361-367 according to SEQ ID NO:45, positions 600-606 according to SEQ ID NO:50, position 556 according to SEQ ID NO:36, position 457 according to SEQ ID NO:41, position 378 according to SEQ ID NO:46, position 617 according to SEQ ID NO:51, position 910 according to SEQ ID NO:37, position 811 according to SEQ ID NO:42, position 732 according to SEQ ID NO:47, position 971 according to SEQ ID NO:52, positions 919-922 according to SEQ ID NO:38, positions 820-823 according to SEQ ID NO:43, positions 741-744 according to SEQ ID NO:48, positions 980-983 according to SEQ ID NO:53, position 1,410 according to SEQ ID NO:39, position 1,311 according to SEQ ID NO:44, position 1,232 according to SEQ ID NO:49, position 1,471 according to SEQ ID NO:54, position 830 according to SEQ ID NO:104, position 731 according to SEQ ID NO:105, position 652 according to SEQ ID NO:106, or position 891 according to SEQ ID NO:107;

b) extending the primer at least through the position of the nucleotide sequence of the GPR75 cDNA molecule corresponding to: positions 539-545 according to SEQ ID NO:35, positions 440-446 according to SEQ ID NO:40, positions 361-367 according to SEQ ID NO:45, positions 600-606 according to SEQ ID NO:50, position 556 according to SEQ ID NO:36, position 457 according to SEQ ID NO:41, position 378 according to SEQ ID NO:46, position 617 according to SEQ ID NO:51, position 910 according to SEQ ID NO:37, position 811 according to SEQ ID NO:42, position 732 according to SEQ ID NO:47, position 971 according to SEQ ID NO:52, positions 919-922 according to SEQ ID NO:38, positions 820-823 according to SEQ ID NO:43, positions 741-744 according to SEQ ID NO:48, positions 980-983 according to SEQ ID NO:53, position 1,410 according to SEQ ID NO:39, position 1,311 according to SEQ ID NO:44, position 1,232 according to SEQ ID NO:49, or position 1,471 according to SEQ ID NO:54, position 830 according to SEQ ID NO:104, position 731 according to SEQ ID NO:105, position 652 according to SEQ ID NO:106, or position 891 according to SEQ ID NO:107; and c) determining whether the extension product of the primer: lacks a CCAGTAG heptanucleotide at positions corresponding to positions 539-545 according to SEQ ID NO:31, lacks a CCAGTAG heptanucleotide at positions corresponding to positions 440-446 according to SEQ ID NO:32, lacks a CCAGTAG heptanucleotide at positions corresponding to positions 361-367 according to SEQ ID NO:33, lacks a CCAGTAG heptanucleotide at positions corresponding to positions 600-606 according to SEQ ID NO:34, comprises an adenine at a position corresponding to position 556 according to SEQ ID NO:36, comprises an adenine at a position corresponding to position 457 according to SEQ ID NO:41, comprises an adenine at a position corresponding to position 378 according to SEQ ID NO:46, comprises an adenine at a position corresponding to position 617 according to SEQ ID NO:51, comprises a thymine at a position corresponding to position 910 according to SEQ ID NO:37, comprises a thymine at a position corresponding to position 811 according to SEQ ID NO:42, comprises a thymine at a position corresponding to position 732 according to SEQ ID NO:47, comprises a thymine at a position corresponding to position 971 according to SEQ ID NO:52, lacks an AAAG tetranucleotide at positions corresponding to positions 919-922 according to SEQ ID NO:31, lacks an AAAG tetranucleotide at positions corresponding to positions 820-823 according to SEQ ID NO:32, lacks an AAAG tetranucleotide at positions corresponding to positions 741-744 according to SEQ ID NO:33, lacks an AAAG tetranucleotide at positions corresponding to positions 980-983 according to SEQ ID NO:34, comprises an insertion of a thymine at a position corresponding to position 1,410 according to SEQ ID NO:39, comprises an insertion of a thymine at a position corresponding to position 1,311 according to SEQ ID NO:44, comprises an insertion of a thymine at a position corresponding to position 1,232 according to SEQ ID NO:49, comprises an insertion of a thymine at a position corresponding to position 1,471 according to SEQ ID NO:54, comprises a guanine at a position corresponding to position 830 according to SEQ ID NO:104, comprises a guanine at a position corresponding to position 731 according to SEQ ID NO:105, comprises a guanine at a position corresponding to position 652 according to SEQ ID NO:106, or comprises a guanine at a position corresponding to position 891 according to SEQ ID NO:107.

Embodiment 90. The method according to any one of embodiments 84 to 89, wherein the assay comprises sequencing the entire nucleic acid molecule.

Embodiment 91. The method according to embodiment 82 or embodiment 83, wherein the assay comprises:

a) amplifying at least a portion of the nucleic acid molecule that encodes the human GPR75 polypeptide, wherein the portion: lacks a CCAGTAG heptanucleotide at positions corresponding to positions 5,540-5,546 according to SEQ ID NO:1, or the complement thereof; comprises an adenine at a position corresponding to position 5,557 according to SEQ ID NO:3, or the complement thereof; comprises a thymine at a position corresponding to position 5,911 according to SEQ ID NO:4, or the complement thereof; lacks an AAAG tetranucleotide at positions corresponding to positions 5,920-5,923 according to SEQ ID NO:1, or the complement thereof; comprises an insertion of a thymine at a position corresponding to position 6,411 according to SEQ ID NO:6, or the complement thereof; or position 5,831 according to SEQ ID NO:99, or the complement thereof;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGTAG heptanucleotide at positions corresponding to positions 5,540-5,546 according to SEQ ID NO:1, or the complement thereof; comprising an adenine at a position corresponding to position 5,557 according to SEQ ID NO:3, or the complement thereof; comprising a thymine at a position corresponding to position 5,911 according to SEQ ID NO:4, or the complement thereof; lacking an AAAG tetranucleotide at positions corresponding to positions 5,920-5,923 according to SEQ ID NO:1, or the complement thereof; comprising an insertion of a thymine at a position corresponding to position 6,411 according to SEQ ID NO:6, or the complement thereof; or comprising a guanine at a position corresponding to position 5,831 according to SEQ ID NO:99, or the complement thereof; and d) detecting the detectable label.

Embodiment 92. The method according to embodiment 82 or embodiment 83, wherein the assay comprises:

a) amplifying at least a portion of the nucleic acid molecule that encodes the human GPR75 polypeptide, wherein the portion: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; comprises an adenine at a position corresponding to position 556 according to SEQ ID NO:12, or the complement thereof; comprises an adenine at a position corresponding to position 457 according to SEQ ID NO:17, or the complement thereof; comprises an adenine at a position corresponding to position 378 according to SEQ ID NO:22, or the complement thereof; comprises an adenine at a position corresponding to position 617 according to SEQ ID NO:27, or the complement thereof; comprises a uracil at a position corresponding to position 910 according to SEQ ID NO:13, or the complement thereof; comprises a uracil at a position corresponding to position 811 according to SEQ ID NO:18, or the complement thereof; comprises a uracil at a position corresponding to position 732 according to SEQ ID NO:23, or the complement thereof; comprises a uracil at a position corresponding to position 971 according to SEQ ID NO:28, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; comprises an insertion of a uracil at a position corresponding to position 1,471 according to SEQ ID NO:30, or the complement thereof; comprises a guanine at a position corresponding to position 830 according to SEQ ID NO:100, or the complement thereof; comprises a guanine at a position corresponding to position 731 according to SEQ ID NO:101, or the complement thereof; comprises a guanine at a position corresponding to position 652 according to SEQ ID NO:102, or the complement thereof; or comprises a guanine at a position corresponding to position 891 according to SEQ ID NO:103, or the complement thereof;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; lacking a CCAGUAG heptanucleotide at positions corresponding to positions 600-606 according to SEQ ID NO:10, or the complement thereof; comprising an adenine at a position corresponding to position 556 according to SEQ ID NO:12, or the complement thereof; comprising an adenine at a position corresponding to position 457 according to SEQ ID NO:17, or the complement thereof; comprising an adenine at a position corresponding to position 378 according to SEQ ID NO:22, or the complement thereof; comprising an adenine at a position corresponding to position 617 according to SEQ ID NO:27, or the complement thereof; comprising a uracil at a position corresponding to position 910 according to SEQ ID NO:13, or the complement thereof; comprising a uracil at a position corresponding to position 811 according to SEQ ID NO:18, or the complement thereof; comprising a uracil at a position corresponding to position 732 according to SEQ ID NO:23, or the complement thereof; comprising a uracil at a position corresponding to position 971 according to SEQ ID NO:28, or the complement thereof; lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; lacking an AAAG tetranucleotide at positions corresponding to positions 980-983 according to SEQ ID NO:10, or the complement thereof; comprising an insertion of a uracil at a position corresponding to position 1,410 according to SEQ ID NO:15, or the complement thereof; comprising an insertion of a uracil at a position corresponding to position 1,311 according to SEQ ID NO:20, or the complement thereof; comprising an insertion of a uracil at a position corresponding to position 1,232 according to SEQ ID NO:25, or the complement thereof; comprising an insertion of a uracil at a position corresponding to position 1,471 according to SEQ ID NO:30, or the complement thereof; comprising a guanine at a position corresponding to position 830 according to SEQ ID NO:100, or the complement thereof; comprising a guanine at a position corresponding to position 731 according to SEQ ID NO:101, or the complement thereof; comprising a guanine at a position corresponding to position 652 according to SEQ ID NO:102, or the complement thereof; or comprising a guanine at a position corresponding to position 891 according to SEQ ID NO:103, or the complement thereof; and d) detecting the detectable label.

Embodiment 93. The method according to embodiment 82 or embodiment 83, wherein the assay comprises:

a) amplifying at least a portion of the nucleic acid molecule that encodes the human GPR75 polypeptide, wherein the portion: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; comprises an adenine at a position corresponding to position 556 according to SEQ ID NO:36, or the complement thereof; comprises an adenine at a position corresponding to position 457 according to SEQ ID NO:41, or the complement thereof; comprises an adenine at a position corresponding to position 378 according to SEQ ID NO:46, or the complement thereof; comprises an adenine at a position corresponding to position 617 according to SEQ ID NO:51, or the complement thereof; comprises a thymine at a position corresponding to position 910 according to SEQ ID NO:37, or the complement thereof; comprises a thymine at a position corresponding to position 811 according to SEQ ID NO:42, or the complement thereof; comprises a thymine at a position corresponding to position 732 according to SEQ ID NO:47, or the complement thereof; comprises a thymine at a position corresponding to position 971 according to SEQ ID NO:52, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, or the complement thereof; comprises an insertion of a thymine at a position corresponding to position 1,471 according to SEQ ID NO:54, or the complement thereof; comprises a guanine at a position corresponding to position 830 according to SEQ ID NO:104, or the complement thereof; comprises a guanine at a position corresponding to position 731 according to SEQ ID NO:105, or the complement thereof; comprises a guanine at a position corresponding to position 652 according to SEQ ID NO:106, or the complement thereof; or comprises a guanine at a position corresponding to position 891 according to SEQ ID NO:107, or the complement thereof;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule: lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; lacking a CCAGTAG heptanucleotide at positions corresponding to positions 600-606 according to SEQ ID NO:34, or the complement thereof; comprising an adenine at a position corresponding to position 556 according to SEQ ID NO:36, or the complement thereof; comprising an adenine at a position corresponding to position 457 according to SEQ ID NO:41, or the complement thereof; comprising an adenine at a position corresponding to position 378 according to SEQ ID NO:46, or the complement thereof; comprising an adenine at a position corresponding to position 617 according to SEQ ID NO:51, or the complement thereof; comprising a thymine at a position corresponding to position 910 according to SEQ ID NO:37, or the complement thereof; comprising a thymine at a position corresponding to position 811 according to SEQ ID NO:42, or the complement thereof; comprising a thymine at a position corresponding to position 732 according to SEQ ID NO:47, or the complement thereof; comprising a thymine at a position corresponding to position 971 according to SEQ ID NO:52, or the complement thereof; lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; lacking an AAAG tetranucleotide at positions corresponding to positions 980-983 according to SEQ ID NO:34, or the complement thereof; comprising an insertion of a thymine at a position corresponding to position 1,410 according to SEQ ID NO:39, or the complement thereof; comprising an insertion of a thymine at a position corresponding to position 1,311 according to SEQ ID NO:44, or the complement thereof; comprising an insertion of a thymine at a position corresponding to position 1,232 according to SEQ ID NO:49, or the complement thereof; comprising an insertion of a thymine at a position corresponding to position 1,471 according to SEQ ID NO:54, or the complement thereof; comprising a guanine at a position corresponding to position 830 according to SEQ ID NO:104, or the complement thereof; comprising a guanine at a position corresponding to position 731 according to SEQ ID NO:105, or the complement thereof; comprising a guanine at a position corresponding to position 652 according to SEQ ID NO:106, or the complement thereof; or comprising a guanine at a position corresponding to position 891 according to SEQ ID NO:107, or the complement thereof; and d) detecting the detectable label.

Embodiment 94. The method according to embodiment 93, wherein the nucleic acid molecule in the sample is mRNA and the mRNA is reverse-transcribed into cDNA prior to the amplifying step.

Embodiment 95. The method according to embodiment 82 or embodiment 83, wherein the assay comprises:

contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGTAG heptanucleotide at positions corresponding to positions 5,540-5,546 according to SEQ ID NO:1, or the complement thereof; comprising an adenine at a position corresponding to position 5,557 according to SEQ ID NO:3, or the complement thereof; comprising a thymine at a position corresponding to position 5,911 according to SEQ ID NO:4, or the complement thereof; lacking an AAAG tetranucleotide at positions corresponding to positions 5,920-5,923 according to SEQ ID NO:1, or the complement thereof; comprising an insertion of a thymine at a position corresponding to position 6,411 according to SEQ ID NO:6, or the complement thereof; or comprising a guanine at a position corresponding to position 5,831 according to SEQ ID NO:99, or the complement thereof; and detecting the detectable label.

Embodiment 96. The method according to embodiment 82 or embodiment 83, wherein the assay comprises:

contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGUAG heptanucleotide at positions corresponding to positions 539-545 according to SEQ ID NO:7, or the complement thereof; lacking a CCAGUAG heptanucleotide at positions corresponding to positions 440-446 according to SEQ ID NO:8, or the complement thereof; lacking a CCAGUAG heptanucleotide at positions corresponding to positions 361-367 according to SEQ ID NO:9, or the complement thereof; lacking a CCAGUAG heptanucleotide at positions corresponding to positions 600-606 according to SEQ ID NO:10, or the complement thereof; comprising an adenine at a position corresponding to position 556 according to SEQ ID NO:12, or the complement thereof; comprising an adenine at a position corresponding to position 457 according to SEQ ID NO:17, or the complement thereof; comprising an adenine at a position corresponding to position 378 according to SEQ ID NO:22, or the complement thereof; comprising an adenine at a position corresponding to position 617 according to SEQ ID NO:27, or the complement thereof; comprising a uracil at a position corresponding to position 910 according to SEQ ID NO:13, or the complement thereof; comprising a uracil at a position corresponding to position 811 according to SEQ ID NO:18, or the complement thereof; comprising a uracil at a position corresponding to position 732 according to SEQ ID NO:23, or the complement thereof; comprising a uracil at a position corresponding to position 971 according to SEQ ID NO:28, or the complement thereof; lacking an AAAG tetranucleotide at positions corresponding to positions 919-922 according to SEQ ID NO:7, or the complement thereof; lacking an AAAG tetranucleotide at positions corresponding to positions 820-823 according to SEQ ID NO:8, or the complement thereof; lacking an AAAG tetranucleotide at positions corresponding to positions 741-744 according to SEQ ID NO:9, or the complement thereof; lacking an AAAG tetranucleotide at positions corresponding to positions 980-983 according to SEQ ID NO:10, or the complement thereof; comprising an insertion of a uracil at a position corresponding to position 1,410 according to SEQ ID NO:15, or the complement thereof; comprising an insertion of a uracil at a position corresponding to position 1,311 according to SEQ ID NO:20, or the complement thereof; comprising an insertion of a uracil at a position corresponding to position 1,232 according to SEQ ID NO:25, or the complement thereof; comprising an insertion of a uracil at a position corresponding to position 1,471 according to SEQ ID NO:30, or the complement thereof; comprising a guanine at a position corresponding to position 830 according to SEQ ID NO:100, or the complement thereof; comprising a guanine at a position corresponding to position 731 according to SEQ ID NO:101, or the complement thereof; comprising a guanine at a position corresponding to position 652 according to SEQ ID NO:102, or the complement thereof; or comprising a guanine at a position corresponding to position 891 according to SEQ ID NO:103, or the complement thereof; and detecting the detectable label.

Embodiment 97. The method according to embodiment 82 or embodiment 83, wherein the assay comprises:

contacting the nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule: lacking a CCAGTAG heptanucleotide at positions corresponding to positions 539-545 according to SEQ ID NO:31, or the complement thereof; lacking a CCAGTAG heptanucleotide at positions corresponding to positions 440-446 according to SEQ ID NO:32, or the complement thereof; lacking a CCAGTAG heptanucleotide at positions corresponding to positions 361-367 according to SEQ ID NO:33, or the complement thereof; lacking a CCAGTAG heptanucleotide at positions corresponding to positions 600-606 according to SEQ ID NO:34, or the complement thereof; comprising an adenine at a position corresponding to position 556 according to SEQ ID NO:36, or the complement thereof; comprising an adenine at a position corresponding to position 457 according to SEQ ID NO:41, or the complement thereof; comprising an adenine at a position corresponding to position 378 according to SEQ ID NO:46, or the complement thereof; comprising an adenine at a position corresponding to position 617 according to SEQ ID NO:51, or the complement thereof; comprising a thymine at a position corresponding to position 910 according to SEQ ID NO:37, or the complement thereof; comprising a thymine at a position corresponding to position 811 according to SEQ ID NO:42, or the complement thereof; comprising a thymine at a position corresponding to position 732 according to SEQ ID NO:47, or the complement thereof; comprising a thymine at a position corresponding to position 971 according to SEQ ID NO:52, or the complement thereof; lacking an AAAG tetranucleotide at positions corresponding to positions 919-922 according to SEQ ID NO:31, or the complement thereof; lacking an AAAG tetranucleotide at positions corresponding to positions 820-823 according to SEQ ID NO:32, or the complement thereof; lacking an AAAG tetranucleotide at positions corresponding to positions 741-744 according to SEQ ID NO:33, or the complement thereof; lacking an AAAG tetranucleotide at positions corresponding to positions 980-983 according to SEQ ID NO:34, or the complement thereof; comprising an insertion of a thymine at a position corresponding to position 1,410 according to SEQ ID NO:39, or the complement thereof; comprising an insertion of a thymine at a position corresponding to position 1,311 according to SEQ ID NO:44, or the complement thereof; comprising an insertion of a thymine at a position corresponding to position 1,232 according to SEQ ID NO:49, or the complement thereof; comprising an insertion of a thymine at a position corresponding to position 1,471 according to SEQ ID NO:54, or the complement thereof; comprising a guanine at a position corresponding to position 830 according to SEQ ID NO:104, or the complement thereof; comprising a guanine at a position corresponding to position 731 according to SEQ ID NO:105, or the complement thereof; comprising a guanine at a position corresponding to position 652 according to SEQ ID NO:106, or the complement thereof; or comprising a guanine at a position corresponding to position 891 according to SEQ ID NO:107, or the complement thereof; and detecting the detectable label.

Embodiment 98. The method according to any one of embodiments 82 to 97, wherein the nucleic acid molecule is present within a cell obtained from the subject.

Embodiment 99. A method of detecting the presence of a human G-Protein Coupled Receptor 75 (GPR75) Ala110fs, Ala116Thr, Tyr207Cys, Gln234Stop, Arg236fs, or Cys400fs variant polypeptide, comprising performing an assay on a sample obtained from a subject to determine whether a GPR75 protein in the sample comprises SEQ ID NO:56, SEQ ID NO:57, SEQ ID NO:58, SEQ ID NO:59, SEQ ID NO:60, or SEQ ID NO:108.

Embodiment 100. The method according to embodiment 99, wherein the assay comprises sequencing the polypeptide.

Embodiment 101. The method according to embodiment 99, wherein the assay is an immunoassay.

Embodiment 102. An isolated alteration-specific probe or alteration-specific primer comprising at least about 15 nucleotides, wherein the alteration-specific probe or alteration-specific primer comprises a nucleotide sequence which is complementary to a portion of a nucleotide sequence encoding a human G-Protein Coupled Receptor 75 (GPR75) polypeptide, wherein the portion comprises a position corresponding to:

positions 5,540-5,546 according to SEQ ID NO:2, or the complement thereof; positions 539-545 according to SEQ ID NO:11, or the complement thereof; positions 440-446 according to SEQ ID NO:16, or the complement thereof; positions 361-367 according to SEQ ID NO:21, or the complement thereof; positions 600-606 according to SEQ ID NO:26, or the complement thereof; positions 539-545 according to SEQ ID NO:35, or the complement thereof; positions 440-446 according to SEQ ID NO:40, or the complement thereof; positions 361-367 according to SEQ ID NO:45, or the complement thereof; or positions 600-606 according to SEQ ID NO:50, or the complement thereof;

positions 5,920-5,923 according to SEQ ID NO:5, or the complement thereof; position 919-922 according to SEQ ID NO:14, or the complement thereof; positions 820-823 according to SEQ ID NO:19, or the complement thereof; positions 741-744 according to SEQ ID NO:24, or the complement thereof; position 980-983 according to SEQ ID NO:29, or the complement thereof; position 919-922 according to SEQ ID NO:38, or the complement thereof; positions 820-823 according to SEQ ID NO:43, or the complement thereof; positions 741-744 according to SEQ ID NO:48, or the complement thereof; or position 980-983 according to SEQ ID NO:53, or the complement thereof; or position 6,411 according to SEQ ID NO:6, or the complement thereof; position 1,410 according to SEQ ID NO:15, or the complement thereof; position 1,311 according to SEQ ID NO:20, or the complement thereof; position 1,232 according to SEQ ID NO:25, or the complement thereof; position 1,471 according to SEQ ID NO:30, or the complement thereof; position 1,410 according to SEQ ID NO:39, or the complement thereof; position 1,311 according to SEQ ID NO:44, or the complement thereof; position 1,232 according to SEQ ID NO:49, or the complement thereof; or position 1,471 according to SEQ ID NO:54, or the complement thereof.

Embodiment 103. The alteration-specific probe or alteration-specific primer according to embodiment 102, comprising a nucleotide sequence which is complementary to a portion of a nucleotide sequence comprising a position corresponding to: positions 5,540-5,546 according to SEQ ID NO:2, or the complement thereof; positions 5,920-5,923 according to SEQ ID NO:5, or the complement thereof; or position 6,411 according to SEQ ID NO:6, or the complement thereof.

Embodiment 104. The alteration-specific probe or alteration-specific primer according to embodiment 102, comprising a nucleotide sequence which is complementary to a portion of a nucleotide sequence comprising a position corresponding to: positions 539-545 according to SEQ ID NO:11, or the complement thereof; positions 440-446 according to SEQ ID NO:16, or the complement thereof; positions 361-367 according to SEQ ID NO:21, or the complement thereof; positions 600-606 according to SEQ ID NO:26, or the complement thereof; position 919-922 according to SEQ ID NO:14, or the complement thereof; positions 820-823 according to SEQ ID NO:19, or the complement thereof; positions 741-744 according to SEQ ID NO:24, or the complement thereof; position 980-983 according to SEQ ID NO:29, or the complement thereof; position 1,410 according to SEQ ID NO:15, or the complement thereof; position 1,311 according to SEQ ID NO:20, or the complement thereof; position 1,232 according to SEQ ID NO:25, or the complement thereof; or position 1,471 according to SEQ ID NO:30, or the complement thereof.

Embodiment 105. The alteration-specific probe or alteration-specific primer according to embodiment 102, comprising a nucleotide sequence which is complementary to a portion of a nucleotide sequence comprising a position corresponding to: positions 539-545 according to SEQ ID NO:35, or the complement thereof; positions 440-446 according to SEQ ID NO:40, or the complement thereof; positions 361-367 according to SEQ ID NO:45, or the complement thereof; positions 600-606 according to SEQ ID NO:50, or the complement thereof; position 919-922 according to SEQ ID NO:38, or the complement thereof; positions 820-823 according to SEQ ID NO:43, or the complement thereof; positions 741-744 according to SEQ ID NO:48, or the complement thereof; position 980-983 according to SEQ ID NO:53, or the complement thereof; position 1,410 according to SEQ ID NO:39, or the complement thereof; position 1,311 according to SEQ ID NO:44, or the complement thereof; position 1,232 according to SEQ ID NO:49, or the complement thereof; or position 1,471 according to SEQ ID NO:54, or the complement thereof.

Embodiment 106. The alteration-specific probe or alteration-specific primer according to any one of embodiments 102 to 105, wherein the alteration-specific probe or alteration-specific primer comprises DNA.

Embodiment 107. The alteration-specific probe or alteration-specific primer according to any one of embodiments 102 to 105, wherein the alteration-specific probe or alteration-specific primer comprises RNA.

Embodiment 108. The alteration-specific probe or alteration-specific primer according to any one of embodiments 102 to 107, wherein the alteration-specific probe or alteration-specific primer comprises a label.

Embodiment 109. The alteration-specific probe or alteration-specific primer according to embodiment 108, wherein the label is a fluorescent label, a radiolabel, or biotin.

Embodiment 110. A support comprising a substrate to which an alteration-specific probe or alteration-specific primer according to any one of embodiments 102 to 109 is attached.

Embodiment 111. The support according to embodiment 110, wherein the support is a microarray.

Embodiment 112. A molecular complex comprising an alteration-specific primer or an alteration-specific probe hybridized to a genomic nucleic acid molecule comprising a nucleotide sequence encoding a human G-Protein Coupled Receptor 75 (GPR75) polypeptide, wherein the alteration-specific primer or the alteration-specific probe is hybridized to the genomic nucleic acid molecule: at nucleotides at positions corresponding to positions 5,539-5,540 according to SEQ ID NO:2, or the complement thereof; at an adenine at a position corresponding to position 5,557 according to SEQ ID NO:3, or the complement thereof; at a thymine at a position corresponding to position 5,911 according to SEQ ID NO:4, or the complement thereof; at nucleotides at positions corresponding to positions 5,919-5,920 according to SEQ ID NO:5, or the complement thereof; at a thymine at a position corresponding to position 6,411 according to SEQ ID NO:6, or the complement thereof; or at a guanine at a position corresponding to position 5,831 according to SEQ ID NO:99, or the complement thereof.

Embodiment 113. The molecular complex according to embodiment 112, wherein the genomic nucleic acid molecule comprises SEQ ID NO:2, SEQ ID NO:3, SEQ ID NO:4, SEQ ID NO:5, SEQ ID NO:6, or SEQ ID NO:99.

Embodiment 114. A molecular complex comprising an alteration-specific primer or an alteration-specific probe hybridized to an mRNA molecule comprising a nucleotide sequence encoding a human G-Protein Coupled Receptor 75 (GPR75) polypeptide, wherein the alteration-specific primer or the alteration-specific probe is hybridized to the mRNA molecule: at nucleotides at positions corresponding to positions 538-539 according to SEQ ID NO:11, or the complement thereof; at nucleotides at positions corresponding to positions 439-440 according to SEQ ID NO:16, or the complement thereof; at nucleotides at positions corresponding to positions 360-361 according to SEQ ID NO:21, or the complement thereof; at nucleotides at positions corresponding to positions 599-600 according to SEQ ID NO:26, or the complement thereof; at an adenine at a position corresponding to position 556 according to SEQ ID NO:12, or the complement thereof; at an adenine at a position corresponding to position 457 according to SEQ ID NO:17, or the complement thereof; at an adenine at a position corresponding to position 378 according to SEQ ID NO:22, or the complement thereof; at an adenine at a position corresponding to position 617 according to SEQ ID NO:27, or the complement thereof; at a uracil at a position corresponding to position 910 according to SEQ ID NO:13, or the complement thereof; at a uracil at a position corresponding to position 811 according to SEQ ID NO:18, or the complement thereof; at a uracil at a position corresponding to position 732 according to SEQ ID NO:23, or the complement thereof; at a uracil at a position corresponding to position 971 according to SEQ ID NO:28, or the complement thereof; at nucleotides at positions corresponding to positions 918-919 according to SEQ ID NO:14, or the complement thereof; at nucleotides at positions corresponding to positions 819-820 according to SEQ ID NO:19, or the complement thereof; at nucleotides at positions corresponding to positions 740-741 according to SEQ ID NO:24, or the complement thereof; at nucleotides at positions corresponding to positions 979-980 according to SEQ ID NO:29, or the complement thereof; at a uracil at a position corresponding to position 1,410 according to SEQ ID NO:15, or the complement thereof; at a uracil at a position corresponding to position 1,311 according to SEQ ID NO:20, or the complement thereof; at a uracil at a position corresponding to position 1,232 according to SEQ ID NO:25, or the complement thereof; at a uracil at a position corresponding to position 1,471 according to SEQ ID NO:30, or the complement thereof; at a guanine at a position corresponding to position 830 according to SEQ ID NO:100, or the complement thereof; at a guanine at a position corresponding to position 731 according to SEQ ID NO:101, or the complement thereof; at a guanine at a position corresponding to position 652 according to SEQ ID NO:102, or the complement thereof; or at a guanine at a position corresponding to position 891 according to SEQ ID NO:103, or the complement thereof.

Embodiment 115. The molecular complex according to embodiment 114, wherein the mRNA molecule comprises SEQ ID NO:11, SEQ ID NO:12, SEQ ID NO:13, SEQ ID NO:14, SEQ ID NO:15, SEQ ID NO:16, SEQ ID NO:17, SEQ ID NO:18, SEQ ID NO:19, SEQ ID NO:20, SEQ ID NO:21, SEQ ID NO:22, SEQ ID NO:23, SEQ ID NO:24, SEQ ID NO:25, SEQ ID NO:26, SEQ ID NO:27, SEQ ID NO:28, SEQ ID NO:29, SEQ ID NO:30, SEQ ID NO:100, SEQ ID NO:101, SEQ ID NO:102, or SEQ ID NO:103.

Embodiment 116. A molecular complex comprising an alteration-specific primer or an alteration-specific probe hybridized to a cDNA molecule comprising a nucleotide sequence encoding a human G-Protein Coupled Receptor 75 (GPR75) polypeptide, wherein the alteration-specific primer or the alteration-specific probe is hybridized to: nucleotides at positions corresponding to positions 538-539 according to SEQ ID NO:35, or the complement thereof; nucleotides at positions corresponding to positions 439-440 according to SEQ ID NO:40, or the complement thereof; nucleotides at positions corresponding to positions 360-361 according to SEQ ID NO:45, or the complement thereof; nucleotides at positions corresponding to positions 599-600 according to SEQ ID NO:50, or the complement thereof; comprising an adenine at a position corresponding to position 556 according to SEQ ID NO:36, or the complement thereof; an adenine at a position corresponding to position 457 according to SEQ ID NO:41, or the complement thereof; an adenine at a position corresponding to position 378 according to SEQ ID NO:46, or the complement thereof; an adenine at a position corresponding to position 617 according to SEQ ID NO:51, or the complement thereof; a thymine at a position corresponding to position 910 according to SEQ ID NO:37, or the complement thereof; a thymine at a position corresponding to position 811 according to SEQ ID NO:42, or the complement thereof; a thymine at a position corresponding to position 732 according to SEQ ID NO:47, or the complement thereof; a thymine at a position corresponding to position 971 according to SEQ ID NO:52, or the complement thereof; nucleotides at positions corresponding to positions 918-919 according to SEQ ID NO:38, or the complement thereof; nucleotides at positions corresponding to positions 819-820 according to SEQ ID NO:43, or the complement thereof; nucleotides at positions corresponding to positions 740-741 according to SEQ ID NO:48, or the complement thereof; nucleotides at positions corresponding to positions 979-980 according to SEQ ID NO:53, or the complement thereof; a thymine at a position corresponding to position 1,410 according to SEQ ID NO:39, or the complement thereof; a thymine at a position corresponding to position 1,311 according to SEQ ID NO:44, or the complement thereof; a thymine at a position corresponding to position 1,232 according to SEQ ID NO:49, or the complement thereof; a thymine at a position corresponding to position 1,471 according to SEQ ID NO:54, or the complement thereof; a guanine at a position corresponding to position 830 according to SEQ ID NO:104, or the complement thereof; a guanine at a position corresponding to position 731 according to SEQ ID NO:105, or the complement thereof; a guanine at a position corresponding to position 652 according to SEQ ID NO:106, or the complement thereof; or a guanine at a position corresponding to position 891 according to SEQ ID NO:107, or the complement thereof.

Embodiment 117. The molecular complex according to embodiment 116, wherein the cDNA molecule comprises SEQ ID NO:35, SEQ ID NO:36, SEQ ID NO:37, SEQ ID NO:38, SEQ ID NO:39, SEQ ID NO:40, SEQ ID NO:41, SEQ ID NO:42, SEQ ID NO:43, SEQ ID NO:44, SEQ ID NO:45, SEQ ID NO:46, SEQ ID NO:47, SEQ ID NO:48, SEQ ID NO:49, SEQ ID NO:50, SEQ ID NO:51, SEQ ID NO:52, SEQ ID NO:53, or SEQ ID NO:54, SEQ ID NO:104, SEQ ID NO:105, SEQ ID NO:106, or SEQ ID NO:107.

Embodiment 118. The molecular complex according to any one of embodiments 112 to 117, wherein the alteration-specific probe or alteration-specific primer comprises a label.

Embodiment 119. The molecular complex according to embodiment 118, wherein the label is a fluorescent label, a radiolabel, or biotin.

Embodiment 120. The molecular complex according to any one of embodiments 112 to 119, further comprising a non-human polymerase.

Embodiment 121. An isolated nucleic acid molecule comprising a nucleotide sequence encoding a human G-Protein Coupled Receptor 75 (GPR75) polypeptide, or the complement thereof, wherein the polypeptide comprises: a frameshift beginning at a position corresponding to position 110 according to SEQ ID NO:56, a frameshift beginning at a position corresponding to position 236 according to SEQ ID NO:59, or a frameshift beginning at a position corresponding to position 400 according to SEQ ID NO:60.

Embodiment 122. The isolated nucleic acid molecule, or the complement thereof, according to embodiment 121, wherein the nucleic acid molecule encodes a GPR75 polypeptide having an amino acid sequence at least about 90% identical to: SEQ ID NO:56, wherein the polypeptide comprises a frameshift beginning at a position corresponding to position 110 according to SEQ ID NO:56; SEQ ID NO:59, wherein the polypeptide comprises a frameshift beginning at a position corresponding to position 236 according to SEQ ID NO:59; or SEQ ID NO:60, wherein the polypeptide comprises a frameshift beginning at a position corresponding to position 400 according to SEQ ID NO:60.

Embodiment 123. The nucleic acid molecule, or complement thereof, according to embodiment 121, wherein the polypeptide comprises SEQ ID NO:56, SEQ ID NO:59, or SEQ ID NO:60.

Embodiment 124. A vector comprising the isolated nucleic acid molecule, or the complement thereof, according to any one of embodiments 121 to 123.

Embodiment 125. The vector according to embodiment 124, wherein the vector is a plasmid.

Embodiment 126. The vector according to embodiment 124, wherein the vector is a virus.

Embodiment 127. A host cell comprising the isolated nucleic acid molecule, or the complement thereof, according to any one of embodiments 121 to 123.

Embodiment 128. A host cell comprising the vector according to any one of embodiments 124 to 126.

Embodiment 129. The host cell according to embodiment 127 or embodiment 128, wherein the nucleotide sequence is operably linked to a promoter active in the host cell.

Embodiment 130. The host cell according to embodiment 129, wherein the promoter is an exogenous promoter.

Embodiment 131. The host cell according to embodiment 129 or embodiment 130, wherein the promoter is an inducible promoter.

Embodiment 132. The host cell according to any one of embodiments 127 to 131, wherein the host cell is a bacterial cell, a yeast cell, an insect cell, or a mammalian cell.

Embodiment 133. A composition comprising the isolated nucleic acid molecule, or the complement thereof, according to any one of embodiments 121 to 123 and a carrier.

Embodiment 134. A composition comprising the vector according to any one of embodiments 124 to 126 and a carrier.

Embodiment 135. An isolated genomic nucleic acid molecule comprising a nucleotide sequence encoding a human G-Protein Coupled Receptor 75 (GPR75) polypeptide, wherein the nucleotide sequence: lacks a CCAGTAG heptanucleotide at positions corresponding to positions 5,540-5,546 according to SEQ ID NO:1, or the complement thereof; a lacks an AAAG tetranucleotide at positions corresponding to positions 5,920-5,923 according to SEQ ID NO:1, or the complement thereof; or comprises an insertion of a thymine at a position corresponding to position 6,411 according to SEQ ID NO:6, or the complement thereof.

Embodiment 136. The isolated genomic nucleic acid molecule, or the complement thereof, according to embodiment 135, wherein the nucleotide sequence has at least 90% sequence identity to: SEQ ID NO:2, and lacks a CCAGTAG heptanucleotide at positions corresponding to positions 5,540-5,546 according to SEQ ID NO:1; SEQ ID NO:5, and lacks an AAAG tetranucleotide at positions corresponding to positions 5,920-5,923 according to SEQ ID NO:1; or SEQ ID NO:6, and comprises an insertion of a thymine at a position corresponding to position 6,411 according to SEQ ID NO:6.

Embodiment 137. The isolated genomic nucleic acid molecule, or the complement thereof, according to embodiment 136, wherein the nucleic acid molecule comprises SEQ ID NO:2, SEQ ID NO:5, or SEQ ID NO:6.

Embodiment 138. A vector comprising the isolated genomic nucleic acid molecule, or the complement thereof, according to any one of embodiments 135 to 137.

Embodiment 139. The vector according to embodiment 138, wherein the vector is a plasmid.

Embodiment 140. The vector according to embodiment 138, wherein the vector is a virus.

Embodiment 141. A host cell comprising the isolated genomic nucleic acid molecule, or the complement thereof, according to any one of embodiments 135 to 137. Embodiment 142. A host cell comprising the vector according to any one of embodiments 138 to 140.

Embodiment 143. The host cell according to embodiment 141 or embodiment 142, wherein the nucleotide sequence is operably linked to a promoter active in the host cell.

Embodiment 144. The host cell according to embodiment 143, wherein the promoter is an exogenous promoter.

Embodiment 145. The host cell according to embodiment 143 or embodiment 144, wherein the promoter is an inducible promoter.

Embodiment 146. The host cell according to any one of embodiments 141 to 145, wherein the host cell is a bacterial cell, a yeast cell, an insect cell, or a mammalian cell.

Embodiment 147. A composition comprising the isolated genomic nucleic acid molecule, or the complement thereof, according to any one of embodiments 135 to 137 and a carrier.

Embodiment 148. A composition comprising the vector according to any one of embodiments 138 to 140 and a carrier.

Embodiment 149. An isolated mRNA molecule comprising a nucleotide sequence encoding a human G-Protein Coupled Receptor 75 (GPR75) polypeptide, wherein the nucleotide sequence: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; or comprises an insertion of a uracil at a position corresponding to position 1,471 according to SEQ ID NO:30, or the complement thereof.

Embodiment 150. The isolated mRNA molecule, or the complement thereof, according to embodiment 149, wherein the nucleotide sequence has at least 90% sequence identity to: SEQ ID NO:11, and lacks a CCAGUAG heptanucleotide at positions corresponding to positions 539-545 according to SEQ ID NO:7; SEQ ID NO:16, and lacks a CCAGUAG heptanucleotide at positions corresponding to positions 440-446 according to SEQ ID NO:8; SEQ ID NO:21, and lacks a CCAGUAG heptanucleotide at positions corresponding to positions 361-367 according to SEQ ID NO:9; SEQ ID NO:26, and lacks a CCAGUAG heptanucleotide at positions corresponding to positions 600-606 according to SEQ ID NO:10; SEQ ID NO:14, and lacks an AAAG tetranucleotide at positions corresponding to positions 919-922 according to SEQ ID NO:7; SEQ ID NO:19, and lacks an AAAG tetranucleotide at positions corresponding to positions 820-823 according to SEQ ID NO:8; SEQ ID NO:24, and lacks an AAAG tetranucleotide at positions corresponding to positions 741-744 according to SEQ ID NO:9; SEQ ID NO:29, and lacks an AAAG tetranucleotide at positions corresponding to positions 980-983 according to SEQ ID NO:10; SEQ ID NO:15, and comprises an insertion of a uracil at a position corresponding to position 1,410 according to SEQ ID NO:15; SEQ ID NO:20, and comprises an insertion of a uracil at a position corresponding to position 1,311 according to SEQ ID NO:20; SEQ ID NO:25, and comprises an insertion of a uracil at a position corresponding to position 1,232 according to SEQ ID NO:25; or SEQ ID NO:30, and comprises an insertion of a uracil at a position corresponding to position 1,471 according to SEQ ID NO:30.

Embodiment 151. The isolated mRNA molecule, or the complement thereof, according to embodiment 149, wherein the nucleic acid molecule comprises SEQ ID NO:11, SEQ ID NO:14, SEQ ID NO:15, SEQ ID NO:16, SEQ ID NO:19, SEQ ID NO:20, SEQ ID NO:21, SEQ ID NO:24, SEQ ID NO:25, SEQ ID NO:26, SEQ ID NO:29, or SEQ ID NO:30.

Embodiment 152. A vector comprising the isolated mRNA molecule, or the complement thereof, according to any one of embodiments 149 to 151.

Embodiment 153. The vector according to embodiment 152, wherein the vector is a plasmid.

Embodiment 154. The vector according to embodiment 152, wherein the vector is a virus.

Embodiment 155. A host cell comprising the isolated mRNA molecule, or the complement thereof, according to any one of embodiments 149 to 151.

Embodiment 156. A host cell comprising the vector according to any one of embodiments 152 to 154.

Embodiment 157. The host cell according to embodiment 155 or embodiment 156, wherein the nucleotide sequence is operably linked to a promoter active in the host cell.

Embodiment 158. The host cell according to embodiment 157, wherein the promoter is an exogenous promoter.

Embodiment 159. The host cell according to embodiment 157 or embodiment 158, wherein the promoter is an inducible promoter.

Embodiment 160. The host cell according to any one of embodiments 155 to 159, wherein the host cell is a bacterial cell, a yeast cell, an insect cell, or a mammalian cell.

Embodiment 161. A composition comprising the isolated mRNA molecule, or the complement thereof, according to any one of embodiments 149 to 151 and a carrier.

Embodiment 162. A composition comprising the vector according to any one of embodiments 152 to 154 and a carrier.

Embodiment 163. An isolated cDNA molecule comprising a nucleotide sequence encoding a human G-Protein Coupled Receptor 75 (GPR75) polypeptide, wherein the nucleotide sequence: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, or the complement thereof; or comprises an insertion of a thymine at a position corresponding to position 1,471 according to SEQ ID NO:54, or the complement thereof.

Embodiment 164. The isolated cDNA molecule, or the complement thereof, according to embodiment 163, wherein the nucleotide sequence has at least 90% sequence identity to: SEQ ID NO:35, and lacks a CCAGTAG heptanucleotide at positions corresponding to positions 539-545 according to SEQ ID NO:31; SEQ ID NO:40, and lacks a CCAGTAG heptanucleotide at positions corresponding to positions 440-446 according to SEQ ID NO:32; SEQ ID NO:45, and lacks a CCAGTAG heptanucleotide at positions corresponding to positions 361-367 according to SEQ ID NO:33; SEQ ID NO:50, and lacks a CCAGTAG heptanucleotide at positions corresponding to positions 600-606 according to SEQ ID NO:34; SEQ ID NO:38, and lacks an AAAG tetranucleotide at positions corresponding to positions 919-922 according to SEQ ID NO:31; SEQ ID NO:43, and lacks an AAAG tetranucleotide at positions corresponding to positions 820-823 according to SEQ ID NO:32; SEQ ID NO:48, and lacks an AAAG tetranucleotide at positions corresponding to positions 741-744 according to SEQ ID NO:33; SEQ ID NO:53, and lacks an AAAG tetranucleotide at positions corresponding to positions 980-983 according to SEQ ID NO:34; SEQ ID NO:39, and comprises an insertion of a thymine at a position corresponding to position 1,410 according to SEQ ID NO:39; SEQ ID NO:44, and comprises an insertion of a thymine at a position corresponding to position 1,311 according to SEQ ID NO:44; SEQ ID NO:49, and comprises an insertion of a thymine at a position corresponding to position 1,232 according to SEQ ID NO:49; or SEQ ID NO:54, and comprises or an insertion of a thymine at a position corresponding to position 1,471 according to SEQ ID NO:54.

Embodiment 165. The isolated cDNA molecule, or the complement thereof, according to embodiment 163, wherein the nucleic acid molecule comprises SEQ ID NO:35, SEQ ID NO:38, SEQ ID NO:39, SEQ ID NO:40, SEQ ID NO:43, SEQ ID NO:44, SEQ ID NO:45, SEQ ID NO:48, SEQ ID NO:49, SEQ ID NO:50, SEQ ID NO:53, or SEQ ID NO:54.

Embodiment 166. A vector comprising the cDNA molecule, or the complement thereof, according to any one of embodiments 163 to 165.

Embodiment 167. The vector according to embodiment 166, wherein the vector is a plasmid.

Embodiment 168. The vector according to embodiment 166, wherein the vector is a virus.

Embodiment 169. A host cell comprising the cDNA molecule, or the complement thereof, according to any one of embodiments 163 to 165.

Embodiment 170. A host cell comprising the vector according to any one of embodiments 166 to 168.

Embodiment 171. The host cell according to embodiment 169 or embodiment 170, wherein the nucleotide sequence is operably linked to a promoter active in the host cell.

Embodiment 172. The host cell according to embodiment 171, wherein the promoter is an exogenous promoter.

Embodiment 173. The host cell according to embodiment 171 or embodiment 172, wherein the promoter is an inducible promoter.

Embodiment 174. The host cell according to any one of embodiments 169 to 173, wherein the host cell is a bacterial cell, a yeast cell, an insect cell, or a mammalian cell.

Embodiment 175. A composition comprising the cDNA molecule, or the complement thereof, according to any one of embodiments 163 to 165 and a carrier.

Embodiment 176. A composition comprising the vector according to any one of embodiments 166 to 168 and a carrier.

Embodiment 177. An isolated human G-Protein Coupled Receptor 75 (GPR75) polypeptide having an amino acid sequence at least about 90% identical to: SEQ ID NO:56, wherein the polypeptide lacks amino acids at positions corresponding to positions 110 to 540 according to SEQ ID NO:55; SEQ ID NO:59, wherein the polypeptide lacks amino acids at positions corresponding to positions 236 to 540 according to SEQ ID NO:55; or SEQ ID NO:60, wherein the polypeptide lacks amino acids at positions corresponding to positions 400 to 540 according to SEQ ID NO:55.

Embodiment 178. The polypeptide according to embodiment 177, wherein the polypeptide comprises SEQ ID NO:56, SEQ ID NO:59, or SEQ ID NO:60.

Embodiment 179. The polypeptide according to embodiment 177 or embodiment 178, wherein the polypeptide is fused to a heterologous molecule.

Embodiment 180. The polypeptide according to embodiment 179, wherein the heterologous molecule comprises an immunoglobulin Fc domain, a peptide purification tag, a fluorescent protein, or a transduction domain.

Embodiment 181. The polypeptide according to any one of embodiments 177 to 180, wherein the polypeptide is linked to a label.

Embodiment 182. The polypeptide according to embodiment 181, wherein the label is a fluorescent label or a radiolabel.

Embodiment 183. The polypeptide according to embodiment 181, wherein the label comprises polyethylene glycol, polysialic acid, or glycolic acid.

Embodiment 184. A composition comprising the polypeptide according to any one of embodiments 177 to 183 and a carrier or excipient.

Embodiment 185. A host cell expressing the polypeptide according to any one of embodiments 177 to 183.

Embodiment 186. A method of producing the polypeptide according to any one of embodiments 177 to 183, comprising culturing a host cell comprising a nucleic acid molecule encoding the polypeptide, whereby the host cell expresses the polypeptide, and recovering the expressed polypeptide.

Embodiment 187. The method according to embodiment 186, wherein the nucleic acid molecule is under control of a heterologous promoter.

Embodiment 188. The method according to embodiment 186 or embodiment 187, wherein the nucleic acid molecule is under control of an inducible promoter.

Embodiment 189. An isolated nucleic acid molecule comprising a nucleotide sequence encoding a human G-Protein Coupled Receptor 75 (GPR75) polypeptide, or the complement thereof, wherein the polypeptide: comprises a threonine at a position corresponding to position 116 according to SEQ ID NO:57, terminates at a position corresponding to position 233 according to SEQ ID NO:58, or comprises a cysteine at a position corresponding to position 207 according to SEQ ID NO:99.

Embodiment 190. The isolated nucleic acid molecule, or the complement thereof, according to embodiment 189, wherein the nucleic acid molecule encodes a GPR75 polypeptide having an amino acid sequence at least about 90% identical to: SEQ ID NO:57, wherein the polypeptide comprises a threonine at a position corresponding to position 116 according to SEQ ID NO:57; SEQ ID NO:58, wherein the polypeptide terminates at a position corresponding to position 233 according to SEQ ID NO:58; or SEQ ID NO:99, wherein the polypeptide comprises a cysteine at a position corresponding to position 207 according to SEQ ID NO:99.

Embodiment 191. The nucleic acid molecule, or complement thereof, according to embodiment 189, wherein the polypeptide comprises SEQ ID NO:57, SEQ ID NO:58, or SEQ ID NO:99.

Embodiment 192. A vector comprising the isolated nucleic acid molecule, or the complement thereof, according to any one of embodiments 189 to 191.

Embodiment 193. The vector according to embodiment 192, wherein the vector is a plasmid.

Embodiment 194. The vector according to embodiment 192, wherein the vector is a virus.

Embodiment 195. A host cell comprising the isolated nucleic acid molecule, or the complement thereof, according to any one of embodiments 189 to 191.

Embodiment 196. A host cell comprising the vector according to any one of embodiments 192 to 194.

Embodiment 197. The host cell according to embodiment 195 or embodiment 196, wherein the nucleotide sequence is operably linked to a promoter active in the host cell.

Embodiment 198. The host cell according to embodiment 197, wherein the promoter is an exogenous promoter.

Embodiment 199. The host cell according to embodiment 197 or embodiment 198, wherein the promoter is an inducible promoter.

Embodiment 200. The host cell according to any one of embodiments 195 to 199, wherein the host cell is a bacterial cell, a yeast cell, an insect cell, or a mammalian cell.

Embodiment 201. A composition comprising the isolated nucleic acid molecule, or the complement thereof, according to any one of embodiments 189 to 191 and a carrier.

Embodiment 202. A composition comprising the vector according to any one of embodiments 192 to 194 and a carrier.

Embodiment 203. An isolated mRNA molecule comprising a nucleotide sequence encoding a human G-Protein Coupled Receptor 75 (GPR75) polypeptide, wherein the nucleotide sequence comprises: comprising an adenine at a position corresponding to position 556 according to SEQ ID NO:12, or the complement thereof; comprising an adenine at a position corresponding to position 457 according to SEQ ID NO:17, or the complement thereof; comprising an adenine at a position corresponding to position 378 according to SEQ ID NO:22, or the complement thereof; comprising an adenine at a position corresponding to position 617 according to SEQ ID NO:27, or the complement thereof; comprising a uracil at a position corresponding to position 910 according to SEQ ID NO:13, or the complement thereof; comprising a uracil at a position corresponding to position 811 according to SEQ ID NO:18, or the complement thereof; comprising a uracil at a position corresponding to position 732 according to SEQ ID NO:23, or the complement thereof; comprising a uracil at a position corresponding to position 971 according to SEQ ID NO:28, or the complement thereof; comprising a guanine at a position corresponding to position 830 according to SEQ ID NO:100, or the complement thereof; comprising a guanine at a position corresponding to position 731 according to SEQ ID NO:101, or the complement thereof; comprising a guanine at a position corresponding to position 652 according to SEQ ID NO:102, or the complement thereof; or comprising a guanine at a position corresponding to position 891 according to SEQ ID NO:103, or the complement thereof.

Embodiment 204. The isolated mRNA molecule, or the complement thereof, according to embodiment 203, wherein the nucleotide sequence has at least 90% sequence identity to: SEQ ID NO:12 and comprises an adenine at a position corresponding to position 556 according to SEQ ID NO:12, or the complement thereof; SEQ ID NO:17 and comprises an adenine at a position corresponding to position 457 according to SEQ ID NO:17, or the complement thereof; SEQ ID NO:22 and comprises an adenine at a position corresponding to position 378 according to SEQ ID NO:22, or the complement thereof; SEQ ID NO:27 and comprises an adenine at a position corresponding to position 617 according to SEQ ID NO:27, or the complement thereof; SEQ ID NO:13 and comprises a uracil at a position corresponding to position 910 according to SEQ ID NO:13, or the complement thereof; SEQ ID NO:18 and comprises a uracil at a position corresponding to position 811 according to SEQ ID NO:18, or the complement thereof; SEQ ID NO:23 and comprises a uracil at a position corresponding to position 732 according to SEQ ID NO:23, or the complement thereof; SEQ ID NO:28 and comprises a uracil at a position corresponding to position 971 according to SEQ ID NO:28, or the complement thereof; SEQ ID NO:100 and comprises a guanine at a position corresponding to position 830 according to SEQ ID NO:100, or the complement thereof; SEQ ID NO:101 and comprises a guanine at a position corresponding to position 731 according to SEQ ID NO:101, or the complement thereof; SEQ ID NO:102 and comprises a guanine at a position corresponding to position 652 according to SEQ ID NO:102, or the complement thereof; or SEQ ID NO:103 and comprises a guanine at a position corresponding to position 891 according to SEQ ID NO:103, or the complement thereof.

Embodiment 205. The isolated mRNA molecule, or the complement thereof, according to embodiment 203, wherein the nucleic acid molecule comprises SEQ ID NO:12, SEQ ID NO:17, SEQ ID NO:22, SEQ ID NO:27, SEQ ID NO:13, SEQ ID NO:18, SEQ ID NO:23, SEQ ID NO:28, SEQ ID NO:100, SEQ ID NO:101, SEQ ID NO:102, or SEQ ID NO:103.

Embodiment 206. A vector comprising the isolated mRNA molecule, or the complement thereof, according to any one of embodiments 203 to 205.

Embodiment 207. The vector according to embodiment 206, wherein the vector is a plasmid.

Embodiment 208. The vector according to embodiment 206, wherein the vector is a virus.

Embodiment 209. A host cell comprising the isolated mRNA molecule, or the complement thereof, according to any one of embodiments 203 to 205.

Embodiment 210. A host cell comprising the vector according to any one of embodiments 206 to 208.

Embodiment 211. The host cell according to embodiment 209 or embodiment 210, wherein the nucleotide sequence is operably linked to a promoter active in the host cell.

Embodiment 212. The host cell according to embodiment 211, wherein the promoter is an exogenous promoter.

Embodiment 213. The host cell according to embodiment 211 or embodiment 212, wherein the promoter is an inducible promoter.

Embodiment 214. The host cell according to any one of embodiments 209 to 213, wherein the host cell is a bacterial cell, a yeast cell, an insect cell, or a mammalian cell.

Embodiment 215. A composition comprising the isolated mRNA molecule, or the complement thereof, according to any one of embodiments 203 to 205 and a carrier.

Embodiment 216. A composition comprising the vector according to any one of embodiments 206 to 208 and a carrier.

Embodiment 217. An isolated cDNA molecule comprising a nucleotide sequence encoding a human G-Protein Coupled Receptor 75 (GPR75) polypeptide, wherein the nucleotide sequence comprises: comprising an adenine at a position corresponding to position 556 according to SEQ ID NO:36, or the complement thereof; comprising an adenine at a position corresponding to position 457 according to SEQ ID NO:41, or the complement thereof; comprising an adenine at a position corresponding to position 378 according to SEQ ID NO:46, or the complement thereof; comprising an adenine at a position corresponding to position 617 according to SEQ ID NO:51, or the complement thereof; comprising a thymine at a position corresponding to position 910 according to SEQ ID NO:37, or the complement thereof; comprising a thymine at a position corresponding to position 811 according to SEQ ID NO:42, or the complement thereof; comprising a thymine at a position corresponding to position 732 according to SEQ ID NO:47, or the complement thereof; comprising a thymine at a position corresponding to position 971 according to SEQ ID NO:52, or the complement thereof; comprising a guanine at a position corresponding to position 830 according to SEQ ID NO:104, or the complement thereof; comprising a guanine at a position corresponding to position 731 according to SEQ ID NO:105, or the complement thereof; comprising a guanine at a position corresponding to position 652 according to SEQ ID NO:106, or the complement thereof; or comprising a guanine at a position corresponding to position 891 according to SEQ ID NO:107, or the complement thereof.

Embodiment 218. The isolated cDNA molecule, or the complement thereof, according to embodiment 217, wherein the nucleotide sequence has at least 90% sequence identity to: SEQ ID NO:36 and comprises an adenine at a position corresponding to position 556 according to SEQ ID NO:36, or the complement thereof; SEQ ID NO:41 and comprises an adenine at a position corresponding to position 457 according to SEQ ID NO:41, or the complement thereof; SEQ ID NO:46 and comprises an adenine at a position corresponding to position 378 according to SEQ ID NO:46, or the complement thereof; SEQ ID NO:51 and comprises an adenine at a position corresponding to position 617 according to SEQ ID NO:51, or the complement thereof; SEQ ID NO:37 and comprises a thymine at a position corresponding to position 910 according to SEQ ID NO:37, or the complement thereof; SEQ ID NO:42 and comprises a thymine at a position corresponding to position 811 according to SEQ ID NO:42, or the complement thereof; SEQ ID NO:47 and comprises a thymine at a position corresponding to position 732 according to SEQ ID NO:47, or the complement thereof; SEQ ID NO:52 and comprises a thymine at a position corresponding to position 971 according to SEQ ID NO:52, or the complement thereof; SEQ ID NO:104 and comprises a guanine at a position corresponding to position 830 according to SEQ ID NO:104, or the complement thereof; SEQ ID NO:105 and comprises a guanine at a position corresponding to position 731 according to SEQ ID NO:105, or the complement thereof; SEQ ID NO:106 and comprises a guanine at a position corresponding to position 652 according to SEQ ID NO:106, or the complement thereof; or SEQ ID NO:107 and comprises a guanine at a position corresponding to position 891 according to SEQ ID NO:107, or the complement thereof.

Embodiment 219. The isolated cDNA molecule, or the complement thereof, according to embodiment 217, wherein the nucleic acid molecule comprises SEQ ID NO:36, SEQ ID NO:41, SEQ ID NO:46, SEQ ID NO:51, SEQ ID NO:37, SEQ ID NO:42, SEQ ID NO:47, SEQ ID NO:52, SEQ ID NO:104, SEQ ID NO:105, SEQ ID NO:106, or SEQ ID NO:107. Embodiment 220. A vector comprising the isolated cDNA molecule, or the complement thereof, according to any one of embodiments 217 to 219.

Embodiment 221. The vector according to embodiment 220, wherein the vector is a plasmid.

Embodiment 222. The vector according to embodiment 220, wherein the vector is a virus.

Embodiment 223. A host cell comprising the isolated cDNA molecule, or the complement thereof, according to any one of embodiments 217 to 219.

Embodiment 224. A host cell comprising the vector according to any one of embodiments 220 to 222.

Embodiment 225. The host cell according to embodiment 223 or embodiment 224, wherein the nucleotide sequence is operably linked to a promoter active in the host cell.

Embodiment 226. The host cell according to embodiment 225, wherein the promoter is an exogenous promoter.

Embodiment 227. The host cell according to embodiment 225 or embodiment 226, wherein the promoter is an inducible promoter.

Embodiment 228. The host cell according to any one of embodiments 223 to 227, wherein the host cell is a bacterial cell, a yeast cell, an insect cell, or a mammalian cell.

Embodiment 229. A composition comprising the isolated cDNA molecule, or the complement thereof, according to any one of embodiments 217 to 219 and a carrier.

Embodiment 230. A composition comprising the vector according to any one of embodiments 220 to 222 and a carrier.

Embodiment 231. An isolated genomic nucleic acid molecule comprising a nucleotide sequence encoding a human G-Protein Coupled Receptor 75 (GPR75) polypeptide, wherein the nucleotide sequence comprises: an adenine at a position corresponding to position 5,557 according to SEQ ID NO:3, or the complement thereof; a thymine at a position corresponding to position 5,911 according to SEQ ID NO:4, or the complement thereof; or a guanine at a position corresponding to position 5,831 according to SEQ ID NO:99, or the complement thereof.

Embodiment 232. The isolated genomic nucleic acid molecule, or the complement thereof, according to embodiment 231, wherein the nucleotide sequence has at least 90% sequence identity to: SEQ ID NO:3, and comprises an adenine at a position corresponding to position 5,557 according to SEQ ID NO:3; SEQ ID NO:4, and comprises a thymine at a position corresponding to position 5,911 according to SEQ ID NO:4; or SEQ ID NO:99, and comprises a guanine at a position corresponding to position 5,831 according to SEQ ID NO:99.

Embodiment 233. The isolated genomic nucleic acid molecule, or the complement thereof, according to embodiment 231, wherein the nucleic acid molecule comprises SEQ ID NO:3, SEQ ID NO:4, or SEQ ID NO:99.

Embodiment 234. A vector comprising the isolated genomic nucleic acid molecule, or the complement thereof, according to any one of embodiments 231 to 233.

Embodiment 235. The vector according to embodiment 234, wherein the vector is a plasmid.

Embodiment 236. The vector according to embodiment 234, wherein the vector is a virus.

Embodiment 237. A host cell comprising the isolated genomic nucleic acid molecule, or the complement thereof, according to any one of embodiments 231 to 233.

Embodiment 238. A host cell comprising the vector according to any one of embodiments 234 to 236.

Embodiment 239. The host cell according to embodiment 237 or embodiment 238, wherein the nucleotide sequence is operably linked to a promoter active in the host cell.

Embodiment 240. The host cell according to embodiment 239, wherein the promoter is an exogenous promoter.

Embodiment 241. The host cell according to embodiment 239 or embodiment 240, wherein the promoter is an inducible promoter.

Embodiment 242. The host cell according to any one of embodiments 237 to 241, wherein the host cell is a bacterial cell, a yeast cell, an insect cell, or a mammalian cell.

Embodiment 243. A composition comprising the isolated genomic nucleic acid molecule, or the complement thereof, according to any one of embodiments 231 to 233 and a carrier.

Embodiment 244. A composition comprising the vector according to any one of embodiments 234 to 236 and a carrier.

Embodiment 245. An isolated human G-Protein Coupled Receptor 75 (GPR75) polypeptide having an amino acid sequence at least about 90% identical to: SEQ ID NO:57, wherein the polypeptide comprises a threonine at a position corresponding to position 116 according to SEQ ID NO:57; SEQ ID NO:58, wherein the polypeptide terminates at a position corresponding to position 233 according to SEQ ID NO:58; or SEQ ID NO:99, wherein the polypeptide comprises a cysteine at a position corresponding to position 207 according to SEQ ID NO:99.

Embodiment 246. The polypeptide according to embodiment 245, wherein the polypeptide comprises SEQ ID NO:57, SEQ ID NO:58, or SEQ ID NO:99.

Embodiment 247. The polypeptide according to embodiment 245 or embodiment 246, wherein the polypeptide is fused to a heterologous molecule.

Embodiment 248. The polypeptide according to embodiment 247, wherein the heterologous molecule comprises an immunoglobulin Fc domain, a peptide purification tag, a fluorescent protein, or a transduction domain.

Embodiment 249. The polypeptide according to any one of embodiments 245 to 248, wherein the polypeptide is linked to a label.

Embodiment 250. The polypeptide according to embodiment 249, wherein the label is a fluorescent label or a radiolabel.

Embodiment 251. The polypeptide according to embodiment 249, wherein the label comprises polyethylene glycol, polysialic acid, or glycolic acid.

Embodiment 252. A composition comprising the polypeptide according to any one of embodiments 245 to 251 and a carrier or excipient.

Embodiment 253. A host cell expressing the polypeptide according to any one of embodiments 245 to 251.

Embodiment 254. A method of producing the polypeptide according to any one of embodiments 245 to 251, comprising culturing a host cell comprising a nucleic acid molecule encoding the polypeptide, whereby the host cell expresses the polypeptide, and recovering the expressed polypeptide.

Embodiment 255. The method according to embodiment 254, wherein the nucleic acid molecule is under control of a heterologous promoter.

Embodiment 256. The method according to embodiment 254 or embodiment 255, wherein the nucleic acid molecule is under control of an inducible promoter.

Embodiment 257. A therapeutic agent that treats or inhibits obesity for use in the treatment of obesity in a subject having:

a genomic nucleic acid molecule having a nucleotide sequence encoding a human G-Protein Coupled Receptor 75 (GPR75) polypeptide, wherein the nucleotide sequence: lacks a CCAGTAG heptanucleotide at positions corresponding to positions 5,540-5,546 according to SEQ ID NO:1, or the complement thereof; comprises an adenine at a position corresponding to position 5,557 according to SEQ ID NO:3, or the complement thereof; comprises a thymine at a position corresponding to position 5,911 according to SEQ ID NO:4, or the complement thereof; lacks an AAAG tetranucleotide at positions corresponding to positions 5,920-5,923 according to SEQ ID NO:1, or the complement thereof; comprises an insertion of a thymine at a position corresponding to position 6,411 according to SEQ ID NO:6, or the complement thereof; or comprises a guanine at a position corresponding to position 5,831 according to SEQ ID NO:99, or the complement thereof;

an mRNA molecule having a nucleotide sequence encoding a human GPR75 polypeptide, wherein the nucleotide sequence: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; comprises an adenine at a position corresponding to position 556 according to SEQ ID NO:12, or the complement thereof; comprises an adenine at a position corresponding to position 457 according to SEQ ID NO:17, or the complement thereof; comprises an adenine at a position corresponding to position 378 according to SEQ ID NO:22, or the complement thereof; comprises an adenine at a position corresponding to position 617 according to SEQ ID NO:27, or the complement thereof; comprises a uracil at a position corresponding to position 910 according to SEQ ID NO:13, or the complement thereof; comprises a uracil at a position corresponding to position 811 according to SEQ ID NO:18, or the complement thereof; comprises a uracil at a position corresponding to position 732 according to SEQ ID NO:23, or the complement thereof; comprises a uracil at a position corresponding to position 971 according to SEQ ID NO:28, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; comprises an insertion of a uracil at a position corresponding to position 1,471 according to SEQ ID NO:30, or the complement thereof; comprises a guanine at a position corresponding to position 830 according to SEQ ID NO:100, or the complement thereof; comprises a guanine at a position corresponding to position 731 according to SEQ ID NO:101, or the complement thereof; comprises a guanine at a position corresponding to position 652 according to SEQ ID NO:102, or the complement thereof; or comprises a guanine at a position corresponding to position 891 according to SEQ ID NO:103, or the complement thereof; or a cDNA molecule having a nucleotide sequence encoding a human GPR75 polypeptide, wherein the nucleotide sequence: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; comprises an adenine at a position corresponding to position 556 according to SEQ ID NO:36, or the complement thereof; comprises an adenine at a position corresponding to position 457 according to SEQ ID NO:41, or the complement thereof; comprises an adenine at a position corresponding to position 378 according to SEQ ID NO:46, or the complement thereof; comprises an adenine at a position corresponding to position 617 according to SEQ ID NO:51, or the complement thereof; comprises a thymine at a position corresponding to position 910 according to SEQ ID NO:37, or the complement thereof; comprises a thymine at a position corresponding to position 811 according to SEQ ID NO:42, or the complement thereof; comprises a thymine at a position corresponding to position 732 according to SEQ ID NO:47, or the complement thereof; comprises a thymine at a position corresponding to position 971 according to SEQ ID NO:52, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, or the complement thereof; comprises an insertion of a thymine at a position corresponding to position 1,471 according to SEQ ID NO:54, or the complement thereof; comprises a guanine at a position corresponding to position 830 according to SEQ ID NO:104, or the complement thereof; comprises a guanine at a position corresponding to position 731 according to SEQ ID NO:105, or the complement thereof; comprises a guanine at a position corresponding to position 652 according to SEQ ID NO:106, or the complement thereof; or comprises a guanine at a position corresponding to position 891 according to SEQ ID NO:107, or the complement thereof.

Embodiment 258. A G-Protein Coupled Receptor 75 (GPR75) inhibitor for use in the treatment of obesity in a subject having:

a genomic nucleic acid molecule having a nucleotide sequence encoding a human G-Protein Coupled Receptor 75 (GPR75) polypeptide, wherein the nucleotide sequence: lacks a CCAGTAG heptanucleotide at positions corresponding to positions 5,540-5,546 according to SEQ ID NO:1, or the complement thereof; comprises an adenine at a position corresponding to position 5,557 according to SEQ ID NO:3, or the complement thereof; comprises a thymine at a position corresponding to position 5,911 according to SEQ ID NO:4, or the complement thereof; lacks an AAAG tetranucleotide at positions corresponding to positions 5,920-5,923 according to SEQ ID NO:1, or the complement thereof; comprises an insertion of a thymine at a position corresponding to position 6,411 according to SEQ ID NO:6, or the complement thereof; or comprises a guanine at a position corresponding to position 5,831 according to SEQ ID NO:99, or the complement thereof;

an mRNA molecule having a nucleotide sequence encoding a human GPR75 polypeptide, wherein the nucleotide sequence: lacks a CCAGUAG heptanucleotide at positions corresponding to positions 539-545 according to SEQ ID NO:7, or the complement thereof; lacks a CCAGUAG heptanucleotide at positions corresponding to positions 440-446 according to SEQ ID NO:8, or the complement thereof; lacks a CCAGUAG heptanucleotide at positions corresponding to positions 361-367 according to SEQ ID NO:9, or the complement thereof; lacks a CCAGUAG heptanucleotide at positions corresponding to positions 600-606 according to SEQ ID NO:10, or the complement thereof; comprises an adenine at a position corresponding to position 556 according to SEQ ID NO:12, or the complement thereof; comprises an adenine at a position corresponding to position 457 according to SEQ ID NO:17, or the complement thereof; comprises an adenine at a position corresponding to position 378 according to SEQ ID NO:22, or the complement thereof; comprises an adenine at a position corresponding to position 617 according to SEQ ID NO:27, or the complement thereof; comprises a uracil at a position corresponding to position 910 according to SEQ ID NO:13, or the complement thereof; comprises a uracil at a position corresponding to position 811 according to SEQ ID NO:18, or the complement thereof; comprises a uracil at a position corresponding to position 732 according to SEQ ID NO:23, or the complement thereof; comprises a uracil at a position corresponding to position 971 according to SEQ ID NO:28, or the complement thereof; lacks an AAAG tetranucleotide at positions corresponding to positions 919-922 according to SEQ ID NO:7, or the complement thereof; lacks an AAAG tetranucleotide at positions corresponding to positions 820-823 according to SEQ ID NO:8, or the complement thereof; lacks an AAAG tetranucleotide at positions corresponding to positions 741-744 according to SEQ ID NO:9, or the complement thereof; lacks an AAAG tetranucleotide at positions corresponding to positions 980-983 according to SEQ ID NO:10, or the complement thereof; comprises an insertion of a uracil at a position corresponding to position 1,410 according to SEQ ID NO:15, or the complement thereof; comprises an insertion of a uracil at a position corresponding to position 1,311 according to SEQ ID NO:20, or the complement thereof; comprises an insertion of a uracil at a position corresponding to position 1,232 according to SEQ ID NO:25, or the complement thereof; comprises an insertion of a uracil at a position corresponding to position 1,471 according to SEQ ID NO:30, or the complement thereof; comprises a guanine at a position corresponding to position 830 according to SEQ ID NO:100, or the complement thereof; comprises a guanine at a position corresponding to position 731 according to SEQ ID NO:101, or the complement thereof; comprises a guanine at a position corresponding to position 652 according to SEQ ID NO:102, or the complement thereof; or comprises a guanine at a position corresponding to position 891 according to SEQ ID NO:103, or the complement thereof; or a cDNA molecule having a nucleotide sequence encoding a human GPR75 polypeptide, wherein the nucleotide sequence: lacks a CCAGTAG heptanucleotide at positions corresponding to positions 539-545 according to SEQ ID NO:31, or the complement thereof; lacks a CCAGTAG heptanucleotide at positions corresponding to positions 440-446 according to SEQ ID NO:32, or the complement thereof; lacks a CCAGTAG heptanucleotide at positions corresponding to positions 361-367 according to SEQ ID NO:33, or the complement thereof; lacks a CCAGTAG heptanucleotide at positions corresponding to positions 600-606 according to SEQ ID NO:34, or the complement thereof; comprises an adenine at a position corresponding to position 556 according to SEQ ID NO:36, or the complement thereof; comprises an adenine at a position corresponding to position 457 according to SEQ ID NO:41, or the complement thereof; comprises an adenine at a position corresponding to position 378 according to SEQ ID NO:46, or the complement thereof; comprises an adenine at a position corresponding to position 617 according to SEQ ID NO:51, or the complement thereof; comprises a thymine at a position corresponding to position 910 according to SEQ ID NO:37, or the complement thereof; comprises a thymine at a position corresponding to position 811 according to SEQ ID NO:42, or the complement thereof; comprises a thymine at a position corresponding to position 732 according to SEQ ID NO:47, or the complement thereof; comprises a thymine at a position corresponding to position 971 according to SEQ ID NO:52, or the complement thereof; lacks an AAAG tetranucleotide at positions corresponding to positions 919-922 according to SEQ ID NO:31, or the complement thereof; lacks an AAAG tetranucleotide at positions corresponding to positions 820-823 according to SEQ ID NO:32, or the complement thereof; lacks an AAAG tetranucleotide at positions corresponding to positions 741-744 according to SEQ ID NO:33, or the complement thereof; lacks an AAAG tetranucleotide at positions corresponding to positions 980-983 according to SEQ ID NO:34, or the complement thereof; comprises an insertion of a thymine at a position corresponding to position 1,410 according to SEQ ID NO:39, or the complement thereof; comprises an insertion of a thymine at a position corresponding to position 1,311 according to SEQ ID NO:44, or the complement thereof; comprises an insertion of a thymine at a position corresponding to position 1,232 according to SEQ ID NO:49, or the complement thereof; comprises an insertion of a thymine at a position corresponding to position 1,471 according to SEQ ID NO:54, or the complement thereof; comprises a guanine at a position corresponding to position 830 according to SEQ ID NO:104, or the complement thereof; comprises a guanine at a position corresponding to position 731 according to SEQ ID NO:105, or the complement thereof; comprises a guanine at a position corresponding to position 652 according to SEQ ID NO:106, or the complement thereof; or comprises a guanine at a position corresponding to position 891 according to SEQ ID NO:107, or the complement thereof.

Embodiment 259. The GPR75 inhibitor according to embodiment 258, which is an antisense nucleic acid molecule, a small interfering RNA (siRNA), or a short hairpin RNA (shRNA) that hybridizes to a GPR75 mRNA.

Embodiment 260. The GPR75 inhibitor according to embodiment 258, which comprises a Cas protein and guide RNA (gRNA) that hybridizes to a gRNA recognition sequence within a GPR75 genomic nucleic acid molecule.

Embodiment 261. The GPR75 inhibitor according to embodiment 260, wherein the Cas protein is Cas9 or Cpf1.

Embodiment 262. The GPR75 inhibitor according to embodiment 260 or embodiment 261, wherein the gRNA recognition sequence includes or is proximate to: position 5,540-5,546 according to SEQ ID NO:1, position 5,557 according to SEQ ID NO:1, position 5,911 according to SEQ ID NO:1, positions 5,920-5,923 according to SEQ ID NO:1, position 6,411 according to SEQ ID NO:1, or position 5,831 according to SEQ ID NO:1.

Embodiment 263. The GPR75 inhibitor according to embodiment 260 or embodiment 261, wherein the gRNA recognition sequence is located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to: position 5,540-5,546 according to SEQ ID NO:1, position 5,557 according to SEQ ID NO:1, position 5,911 according to SEQ ID NO:1, positions 5,920-5,923 according to SEQ ID NO:1, position 6,411 according to SEQ ID NO:1, or position 5,831 according to SEQ ID NO:1.

Embodiment 264. The GPR75 inhibitor according to embodiment 260 or embodiment 261, wherein a Protospacer Adjacent Motif (PAM) sequence is about 2 to about 6 nucleotides downstream of the gRNA recognition sequence.

Embodiment 265. The GPR75 inhibitor according to any one of embodiments 260 to 264, wherein the gRNA comprises from about 17 to about 23 nucleotides.

Embodiment 266. The GPR75 inhibitor according to any one of embodiments 260 to 265, wherein the gRNA recognition sequence comprises a nucleotide sequence according to any one of SEQ ID NOS:61-98.

The following examples are provided to describe the embodiments in greater detail. They are intended to illustrate, not to limit, the claimed embodiments. The following examples provide those of ordinary skill in the art with a disclosure and description of how the compounds, compositions, articles, devices and/or methods described herein are made and evaluated, and are intended to be purely exemplary and are not intended to limit the scope of any claims. Efforts have been made to ensure accuracy with respect to numbers (such as, for example, amounts, temperature, etc.), but some errors and deviations may be accounted for. Unless indicated otherwise, parts are parts by weight, temperature is in ° C. or is at ambient temperature, and pressure is at or near atmospheric.

EXAMPLES

Example 1: Materials and Methods

Participating Cohorts

Discovery genetic association studies were performed in the United Kingdom (UK) Biobank (UKB) cohort (Sudlow et al., PLoS Med 12, 2015, e1001779), in the MyCode Community Health Initiative cohort from the Geisinger Health System (GHS) (Carey et al., Genet. Med., 2016, 18, 906-913) and in the Mexico City Prospective Study (MCPS) (Tapia-Conyer et al., Int. J. Epidemiol., 2006, 35, 243-249). The UKB is a population-based cohort study of people aged between 40 and 69 years recruited through 22 testing centers in the UK between 2006-2010. A total of 428,719 European ancestry participants with available whole-exome sequencing and clinical phenotype data were included (FIG. 1). UK Biobank has approval from the North West Multi-centre Research Ethics Committee (MREC; 11/NW/0382), which covers the UK. The GHS MyCode study is a health system-based cohort of patients from Central and Eastern Pennsylvania (USA) recruited in 2007-2019. A total of 121,061 European ancestry participants with available whole-exome sequencing and clinical phenotype data were included (FIG. 1). The GHS MyCode study was approved by the Geisinger Institutional Review Board (2006-0258). The MCPS is a cohort study of people aged 35 years recruited from two contiguous urban districts in Mexico City in 1998-2004. The study design and clinical characteristics of participants in MCPS have been described in detail in previous publications (Tapia-Conyer et al., Int. J. Epidemiol., 2006, 35, 243-249; and Alegre-Diaz et al., N. Engl. J. Med., 2016, 375, 1961-1971). A total of 95,846 individuals of Admixed American ancestry with available whole-exome sequencing and clinical phenotype data were included (FIG. 1). The MCPS study was approved by the Mexican Ministry of Health, the Mexican National Council for Science and Technology, and the University of Oxford.

The association with BMI of GPR75 predicted loss-of-function (pLOF) variants was further estimated in an additional 91,328 exomes not included in the discovery set. These included participants of non-European ancestries from the UK Biobank (UKB, N=12,321) (Sudlow et al., PLoS Med 12, 2015, e1001779), and participants in the Mount Sinai BioMe cohort (SINAI, N=21,143), the University of Pennsylvania Medicine BioBank (PMBB; N=7,519), the Duke Catheterization Genetics (CATHGEN) cohort (DUKE; N=8,171) (Kraus et al., J. Cardiovasc. Transl. Res., 2015, 8, 449-457), the Taiwanese Chinese from Taiwan Metabochip consortium (TAICHI; N=11,223) (Assimes et al., PLoS One 11, 2016, e0138014), the Dallas Heart Study (DHS; N=2,088) (Victor et al., Am. J. Cardiol., 2004, 93, 1473-1480) and the Malmö Diet and Cancer Study (MALMO; N=28,863) (Berglund et al., J. Intern. Med., 1993, 233, 45-51). All studies were approved by relevant ethics committees and participants provided informed consent for participation in these studies.

Phenotype Definitions

Body mass index was calculated as weight in kilograms divided by the square of height in meters on the basis of anthropometric measurements taken at one of the study visits. BMI measured at the baseline visit was the outcome variable in UKB and MCPS, while median BMI from clinical encounters present in the GHS database was the outcome variable for GHS consistent with previous studies (Dewey et al., Science, 2016, 354). BMI categories were defined on the basis of the World Health Organization classification (WHO, Obesity and overweight, 2020). BMI values were transformed by the inverse standard normal function, applied within each ancestry group and separately in men and women. Body weight differences were calculated for a person 170 cm tall. Overall and regional body lean and fat masses, percentages and body-surface normalized indices were measured by bioelectrical impedance in the UKB cohort. At the baseline visit, UKB also collected self-reported information on comparative body size at age 10 by asking the multiple choice question: "When you were 10 years old, compared to average would you describe yourself as: thinner, plumper, about average, do not know, prefer not to answer?".

Genotype Data

High coverage whole exome sequencing was performed as previously described in detail (Dewey et al., Science, 2016, 354; and Van Hout et al., Nature, 2020, 586, 749-756) and as summarized below. NimbleGen probes (VCRome; for part of the GHS cohort) or a modified version of the xGen design available from Integrated DNA Technologies (IDT; for the rest of GHS and other cohorts) were used for target sequence capture of the exome. A unique 6 base pair (bp) barcode (VCRome) or 10 bp barcode (IDT) was added to each DNA fragment during library preparation to facilitate multiplexed exome capture and sequencing. Equal amounts of sample were pooled prior to exome capture. Sequencing was performed using 75 bp paired-end reads on Illumina v4 HiSeq 2500 (for part of the GHS cohort) or NovaSeq (for the rest of GHS and other cohorts) instruments. Sequencing had a coverage depth (i.e., number of sequence-reads covering each nucleotide in the target areas of the genome) sufficient to provide greater than 20× coverage over 85% of targeted bases in 96% of VCRome samples and 20× coverage over 90% of targeted bases in 99% of IDT samples. Data processing steps included sample de-multiplexing using Illumina software, alignment to the GRCh38 Human Genome reference sequence including generation of binary alignment and mapping files (BAM), processing of BAM files (e.g., marking of duplicate reads and other read mapping evaluations). Variant calling and annotation were based on the GRCh38 Human Genome reference sequence and Ensembl v85 gene definitions using the snpEff software. The snpEff predictions that involve protein-coding transcripts with an annotated start and stop were then combined into a single functional impact prediction by selecting the most deleterious functional effect class for each gene. The hierarchy (from most to least deleterious) for these annotations was frameshift, stop-gain, stop-loss, splice acceptor, splice donor, stop-lost, in-frame indel, missense, other annotations. Predicted LOF genetic variants included: a) insertions or deletions resulting in a frameshift, b) insertions, deletions or single nucleotide variants resulting in the introduction of a premature stop codon or in the loss of the transcription start site or stop site, and c) variants in donor or acceptor splice sites. Missense variants were classified for likely functional impact according to the number of in silico prediction algorithms that predicted deleteriousness using SIFT (Kumar et al., Nat. Protoc., 2009, 4, 1073-1081), Polyphen2_HDIV and Polyphen2_HVAR (Adzhubei et al., Nat. Methods, 2010, 7, 248-249), LRT (Chun et al., Genome Res., 2009, 19, 1553-1561) and MutationTaster (Schwarz et al., Nat. Methods, 2010, 7, 575-576). For each gene, the alternative allele frequency (AAF) and functional annotation of each variant determined inclusion into these 7 gene burden exposures: 1) pLOF variants with AAF<1%; 2) pLOF or missense variants predicted deleterious by 5/5 algorithms with AAF<1%; 3) pLOF or missense variants predicted deleterious by 5/5 algorithms with AAF<0.1%; 4) pLOF or missense variants predicted deleterious by at least 1/5 algorithms with AAF<1%; 5) pLOF or missense variants predicted deleterious by at least 1/5 algorithms with AAF<0.1%; 6) pLOF or any missense with AAF<1%; and 7) pLOF or any missense variants with AAF<0.1%.

SNP array genotyping was performed in the UKB as previously described (Bycroft et al., Nature, 2018, 562, 203-209). In GHS, genotyping was performed using the Human Omni Express Exome array (OMNI) and the Global Screening array (GSA). In MCPS, genotyping was performed using the GSA array.

In Vitro Studies of GPR75 Variants

In vitro validation studies were performed for two GPR75 pLOF genetic variants (Ala110fs and Gln234*) that were: a) individually associated with lower BMI (p<0.05), and b) had at least 10 heterozygous carriers. Briefly, pcDNA 3.1 plasmids encoding for N-terminally HA-tagged wild-type, Ala110fs and Gln234* GPR75 were transiently transfected using Fugene 6 (Promega) in HEK293 cells. HEK293 and HEK293T cell lines were purchased from ATCC and maintained in the Regeneron Tissue Culture Core. Their identity was confirmed by STR profiling. In vitro assays included mRNA and protein analysis by Taqman and Western Blotting, and protein localization by fluorescence-activated cell sorting and immunofluorescence.

Cell culture, plasmids and cell transfection: HEK293 cells were maintained in Dulbecco's modified Eagle's medium supplemented with 10% fetal bovine serum, and antibiotics (50 units/mL penicillin and 50 µg/mL streptomycin; Thermo Fisher Scientific). pcDNA 3.1 plasmids encoding for N-terminus HA-tagged GPR75 wild-type, Ala110fs and Gln234* were synthesized by GenScript (USA). Cells at approximately 60-70% confluence were transiently transfected with plasmid containing cDNA encoding HA-tagged GPR75 wild-type, Ala110fs and Gln234* and green fluorescent protein control plasmid using FuGENE 6 (Promega) according to the manufacturer's protocol (Promega Literature-#TM350), at a ratio of 1 µg DNA:5 µl FuGENE transfection reagent. After 48 hours, cells were washed with 1×DPBS (Thermo Fisher Scientific) and collected for downstream analysis.

Western blotting: Transfected HEK293 were collected in RIPA buffer for cell lysis and 5-10 µg of protein was loaded per sample. The following primary antibodies were used: HA (mouse monoclonal, Sigma cat. Cat #H3663) and GAPDH 14C10 (Rabbit mAb, Cell Signaling Cat #2118). The appropriate LI-COR secondary IRDye antibodies (anti-rabbit (926-32211) and anti-mouse (926-32210)) were used to detect and quantify immunoblots using a LI-COR Odyssey Infrared Imaging System (LI-COR, Lincoln, Nebr.).

Flow cytometry: Cells were washed once with 1×DPBS (Cat #14190144). Cell Dissociation Buffer (Cat #13150016) was added and cells were incubated at 37° C. for 3 minutes. Cells were re-suspended in culture media and centrifuged at 200×g for 5 minutes. Cells were washed twice with DPBS, re-suspended in DPBS, aliquoted and stained with Live/Dead Blue Fixable Viability Dye (Thermo Fisher Scientific) at room temperature for 15 minutes with no light. Cells were washed twice with DPBS—all washes centrifuged at 400×g for 5 minutes and all staining in the dark. Cells were treated with human Fc Block (BD Biosciences) in MACS buffer (Miltenyi Biotec) for 15 minutes at 4° C. and stained with alexa fluor anti-HA.11 epitope tag antibody (Cat #682404) at 1:100 dilution in MACS buffer for 30 minutes at 4° C. Cells were washed with MACS buffer and fixed with CytoFix (BD Biosciences) for 15 minutes at 4° C. Cells were washed twice with MACS buffer, filtered and FACS was performed on a CytoFLEX (Beckman Coulter). Data was analyzed using FlowJo 10.6.2 (Becton Dickinson & Company).

Immunofluorescence assays: For immunofluorescence assays, cells were seeded onto open 8-well µ-Slides (chamber slide) with a glass bottom (Ibidi, cat #80827) at a density of 14,000 cells/well. At 48 hours post-transfection, cells were fixed in ice-cold 4% PFA for 10 minutes at RT and washed 3× with ice-cold 1×DPBS (all subsequent wash steps were carried out 3 times ice-cold 1×DPBS for 5 minutes per wash). Cells that were not permeabilized were blocked for 1 hour using 10% normal donkey serum (NDS) (Jackson Immunoresearch Laboratories, #017-000-121), while permeabilized cells were blocked in 10% NDS with 0.1% Triton X-100; these were subsequently used as staining buffers for non-permeabilized and permeabilized cells, respectively. Cells were incubated with 1:500 (non-permeabilized) or 1:3000 (permeabilized) anti-HA antibody (Sigma, Cat #H3663) for 1 hour at RT, washed and then incubated for 1 hour with 1:1000 alexa fluor 594-conjugated anti-mouse secondary antibody (Thermo Fisher Scientific, Cat #A-21203). Wells were then washed, and slides were mounted with ProLong® Gold Antifade Reagent with DAPI (Cell Signaling, #8961). Slides were imaged using Zeiss confocal LSM880.

Quantitative real-time polymerase chain reaction: RNA was extracted from transfected HEK293 using TRIzol reagent and following the manufacturer's instructions (Thermo Fisher Scientific). Genomic DNA was removed using MagMAX™Turbo™DNase Buffer and TURBO DNase (Ambion by Life Technologies). mRNA (up to 2 µg) was reverse-transcribed into cDNA using SuperScript® VILO™ Master Mix (ThermoFisher Scientific). GPR75 cDNA was amplified with the PowerUp SYBR Green Master Mix (Thermo Fisher Scientific) using the QuantStudio 6 Flex Real-Time PCR System (Thermo Fisher Scientific). ACTINB housekeeping gene was used as the internal control gene to normalize cDNA input differences. Expression of GPR75 was calculated relative to ACTINB housekeeping gene. Primer sequences were as follows:

```
GPR75-forward:           (SEQ ID NO: 1458)
5'-GCTTGTGGCCCAAGTCATTC-3'

GPR75-reverse:           (SEQ ID NO: 1459)
5'-GAGTGTTGATGGGGGTCGAG-3'

ACT/NB-forward:          (SEQ ID NO: 1460)
5'-CACCATTGGCAATGAGCGGTTC-3'

ACT/NB-reverse:          (SEQ ID NO: 1461)
5'-AGGTCTTTGCGGATGTCCACGT-3'
```

Mouse Models

The genetically engineered Gpr75$^{-/-}$ mouse strain was created using Regeneron's VelociGene® technology (Valenzuela et al., Nat. Biotechnol., 2003, 21, 652-659; and Poueymirou et al., Nat. Biotechnol., 2007, 25, 91-99). Briefly, C57Bl/6NTac embryonic stem cells were targeted for ablation of the entire Gpr75 locus, beginning immediately after the endogenous ATG and ending at the Gpr75 stop codon. Ablation was achieved using a modified bacterial artificial chromosome (BAC) targeting construct such that BAC Gpr75 sequence was replaced with a self-deleting, floxed lacZ reporter cassette containing a neomycin resistance gene under the control of the human UBC (ubiquitin) promoter. The deletion was engineered such that the lacZ reporter was inserted in frame immediately after the endogenous ATG. This construct was electroporated into C57Bl/6NTac embryonic stem cells. Following selection with neomycin, correctly targeted clones were identified by TaqMan analysis and microinjected into 8-cell Swiss Webster embryos (Charles River Laboratories), resulting in F0 VelociMouse® fully derived from the injected modified embryonic stem cells (Poueymirou et al., Nat. Biotechnol., 2007, 25, 91-99).

Heterozygous Gpr75$^{-/+}$ mice were bred to generate age-matched wild type Gpr75$^{+/+}$, heterozygous Gpr75$^{-/+}$ and knock-out Gpr75$^{-/-}$ littermates that were used for experimentation. Male and female mice were housed in static cages (4/cage) with free access to food and water and fed either control chow diet or a high-fat diet (HFD; Envigo, #TD.03584, Huntingdon, UK) for 14 weeks. The control diet consisted of the following components in amounts represented by percent kilocalories (kcal): 13.4% fat, 58.0% carbohydrate, and 28.7% protein. HFD consisted of the following components in percent kilocalories: 58.4% fat, 26.6% carbohydrate, and 15.0% protein.

Fasting blood glucose was measured after overnight fasting before and at the end of the diet-feeding period. An intra-peritoneal glucose tolerance test was performed at the end of the experiment. Followed by an overnight fasting period, glucose (2 g/kg) was administered to each mouse by intra-peritoneal injection. The tip of the tail of each mouse was scratched to draw blood. Blood samples were collected at 0, 30, 60, 90, and 120 minutes, and glucose was measured using Contour blood glucose monitoring system (Bayer, Whippany, N.J.). After these measurements, blood was collected in capillary tubes and used for insulin measurements. Blood was centrifuged at 2,000 rpm for 15 minutes to separate the plasma. Ultra-Sensitive Mouse Insulin ELISA kit (Crystal Chem. #90080, Elk Grove Village, Ill.) was used to quantify plasma insulin levels as per manufacturer's instructions. Plasma levels of leptin and adiponectin were measured by ELISA according to the manufacturer's instructions (Abcam, Cambridge, Mass.; #ab100718 and #ab108785 for leptin and adiponectin, respectively).

Statistics: The Graph Pad Prism version 9 software was used for statistical analysis. Significance of difference in mean values was determined using repeated measures two-way ANOVA followed by Tukey's post hoc multiple comparison test. A p-value<0.05 was considered to be significant.

Additional high-fat and chow diet experiments were conducted in separate cohorts of mice to further characterize body composition and response in a diet induced obesity model.

Statistical Analysis

Overview: The association with BMI of genetic variants or their gene burden was estimated by fitting mixed-effects regression models using BOLT-LMM v2.3.4 (Loh et al., Nat. Genet., 2018, 50, 906-908) or REGENIE v1.0 (Mbatchou et al., Nat. Genet., 2021). These approaches account for relatedness and population structure by estimating a polygenic score using genotypes from across the genome. Then, the association of genetic variants or their burden is estimated conditional upon that polygenic score along with other covariates. To ensure that rare coding variant or gene-burden associations were statistically independent of BMI-associated common genetic variants, exome association analyses were further adjusted for sentinel common variants (AAF≥1%) identified by fine-mapping genome-wide associations of common alleles with BMI as described below. Results across cohorts were pooled using inverse-variance weighted meta-analysis.

Association with BMI of the burden of rare nonsynonymous variants identified by exome-sequencing: In the primary analysis of this study, the association with BMI of the burden of rare nonsynonymous variants in each gene was estimated by fitting mixed-effects regression models adjusted for a polygenic score that approximates a genomic kinship matrix using BOLT-LMM v2.3.4 (Loh et al., Nat. Genet., 2018, 50, 906-908) or REGENIE v1.0 (Mbatchou et al., Nat. Genet., 2021). Analyses were further adjusted for age, age$^2$, sex, an age-by-sex interaction term, experimental batch-related covariates, and genetic principal components. Ensuring that rare variants associations are independent of nearby trait-associated common alleles is essential for the correct causal variant and gene attribution in studies focused on exome variation (Mahajan et al., Nat. Genet., 2018, 50, 559-571). To ensure that burden associations were statistically independent of BMI-associated common genetic variants, the exome-wide association analyses were adjusted for common variants identified by fine-mapping genome-wide associations of common alleles with BMI (see, GWAS of common variants and fine-mapping). In line with previous similar studies (Do et al., Nature, 2015, 518, 102-106; and Flannick et al., Nature, 2019, 570, 71-76), the exome-wide level of statistical significance for the gene burden analysis was defined as $p<3.6\times10^{-07}$, a Bonferroni correction for 20,000 genes and seven variant selection models.

Rare nonsynonymous single variant analysis: In a secondary analysis, the association with BMI of individual rare nonsynonymous variants (minor allele frequency <1% and minor allele count >25) identified by exome sequencing was estimated. The same analytical approach was used as with the gene burden analysis, including adjustment for BMI-associated common variants identified by fine-mapping. This step is preferred to confirm the conditionally-independent nature of the association of these rare variants (Mahajan et al., Nat. Genet., 2018, 50, 559-571). In this analysis, a statistical threshold was used for association of $p<5\times10^{-08}$, a Bonferroni correction for ~1,000,000 rare nonsynonymous variants tested in this analysis which is also the conventional threshold for genome-wide significance used in GWAS (C. Wellcome Trust Case Control, Nature, 2007, 447, 661-678).

GWAS of common variants and fine-mapping: BMI-associated common variants were identified by performing a genome-wide association study including over 12 million common-to-low-frequency genetic variants imputed using the Haplotype Reference Consortium panel (McCarthy et al., Nat. Genet., 2016, 48, 1279-1283) or the TOPMed Imputation Server (see, world wide web at "imputation.biodatacatalyst.nhlbi.nih.gov/#!pages/home; v1.5.7). In the GHS study, imputation was performed separately in samples genotyped with the Illumina Human Omni Express Exome array (OMNI set) and the Global Screening array (GSA set). Dosage data from imputed variants were then merged across the two GHS sets, to obtain a combined dataset for association analysis. Genome-wide association analyses were performed in the GHS, UKB and MCPS cohorts separately by fitting mixed-effects linear regression models using BOLT-LMM v2.3.4 (Loh et al., Nat. Genet., 2018, 50, 906-908) or REGENIE v1.0 (Mbatchou et al., Nat. Genet., 2021). Results from the UKB and GHS analyses were then combined by inverse variance-weighted meta-analysis to obtain a genome-wide meta-analysis in the European subset of the discovery cohorts. To identify conditionally-independent genetic association signals driven by common variants, fine-mapping at genomic regions harboring genetic variants associated with BMI at the genome-wide significance threshold of $p<5\times10^{-08}$ using the FINEMAP software was performed (Benner et al., Bioinformatics, 2016, 32, 1493-1501). Linkage disequilibrium was estimated using genetic data from the exact set of individuals included in the genome-wide association analyses. Fine-mapping was performed separately in the meta-analysis of the European ancestry GHS and UKB cohorts and in the Admixed American ancestry analysis in the MCPS cohort. Fine-mapping identifies independent common variant signals and assigns a posterior probability of causal association (PPA) for variants assigned to a given independent signal. For each locus that was fine-mapped, the 95% credible variant set, i.e., the minimal set of variants that capture the 95% posterior probability of causal association, were identified. The sentinel variant was also defined as the variant with the highest posterior probability of causal association at each given independent signal.

Generation of a genome wide-polygenic score for BMI in the UKB study: A polygenic score capturing predisposition to higher BMI due to over 2.5 million common variants was generated using the LDpred software (Vilhjalmsson et al., Am. J. Hum. Genet., 2015, 97, 576-592) with a rho parameter value of 1, from the results of a previous large genome-wide association study in an independent dataset (Adzhubei et al., Nat. Methods, 2010, 7, 248-249).

Phenome-wide analysis for GPR75 predicted loss-of-function variants: A phenome-wide analysis of the association of pLOF variants in GPR75 with hundreds of continuous traits or disease outcomes in the GHS and UKB studies was performed. To increase power, inverse-variance weighted meta-analysis was performed using the METAL software (Willer et al., Bioinformatics, 2010, 26, 2190-2191) to combine association results across GHS and UKB for disease outcomes available in both studies. To minimize the risk of false positive associations due to the small number of variant carriers, outcomes with 25 individuals carrying GPR75 pLOF genetic variants, determined based on individuals with a non-missing phenotype for continuous traits, or based on affected individuals for binary disease outcomes were excluded. After these exclusions, results were available for 2,173 outcomes. To control for the number of statistical tests performed, associations were considered statistically significant if the association p-value met a Bonferroni correction for 2,173 tests, that is $p<2.3\times10^{-5}$ (corresponding to a p-value threshold of 0.05 divided by 2,173 statistical tests).

Continuous traits and disease outcomes were defined as described below. In the UKB study, for continuous traits, the values of biomarker, imaging variables or other continuous traits measured during one of the UKB visits or their averages within a given study visit or across study visits were used as outcomes. For binary disease outcomes, case status definition required one or more of the following criteria to apply: a) self-reported disease status or use of medication at digital questionnaire or interview with a trained nurse, or b) EHR of inpatient encounters from the UK National Health Service Hospital Episode Statistics database coded using the ICD-10 coding system. For each binary outcome, controls were individuals without any of the criteria for case definition. In the GHS study, for binary disease outcomes, case status definition required one or more of the following criteria to apply: 1) a problem-list entry of the ICD-10 diagnosis code, 2) an inpatient hospitalization-discharge ICD-10 diagnosis code, or 3) an encounter ICD-10 diagnosis code entered for 2 separate outpatient visits on separate calendar days. Controls were individuals without any of the criteria for case definition. Individuals were excluded if they had the relevant ICD-10 code associated with only one outpatient encounter. For continuous traits, data cleaning was performed by removing non-physiological lab values, invalid or contaminated specimens, and those that were over 5× upper limit of normal. Then the minimum, median, and maximum laboratory result values over the duration of follow-up were derived for each patient and used as outcomes.

Example 2: Loss-of-Function in GPR75 is Associated with Lower BMI, Lower Body Fat and Protection Against Obesity High-coverage whole exome sequencing was performed in 645,626 individuals (Example 1), including 428,719 European ancestry individuals from the United Kingdom Biobank cohort (UKB; FIG. 1), 121,061 European ancestry individuals from the MyCode Community Health Initiative cohort from the USA-based Geisinger Health System (GHS; FIG. 1) and 95,846 Admixed American ancestry individuals from the Mexico City Prospective Study (MCPS; FIG. 1).

In an exome-wide meta-analysis across these three cohorts, the burden of rare pLOF variants in the GPR75 gene was associated with lower BMI at the exome-wide level of statistical significance (inverse-variance weighted (IVW) meta-analysis $p<3.6\times10^{-07}$, a Bonferroni correction for 20,000 genes and seven variant selection models (Example 1)).

Predicted loss-of-function variants in GPR75 were observed in ~4 out of every 10,000 sequenced people, with similar frequency across populations (FIG. 2), and carrier status was associated with 0.34 standard deviations lower BMI, corresponding to 1.8 kg/m² lower BMI or approximately 5.3 kg or 12 lbs lower body weight (FIG. 3 and FIG. 4A).

Figure 7:
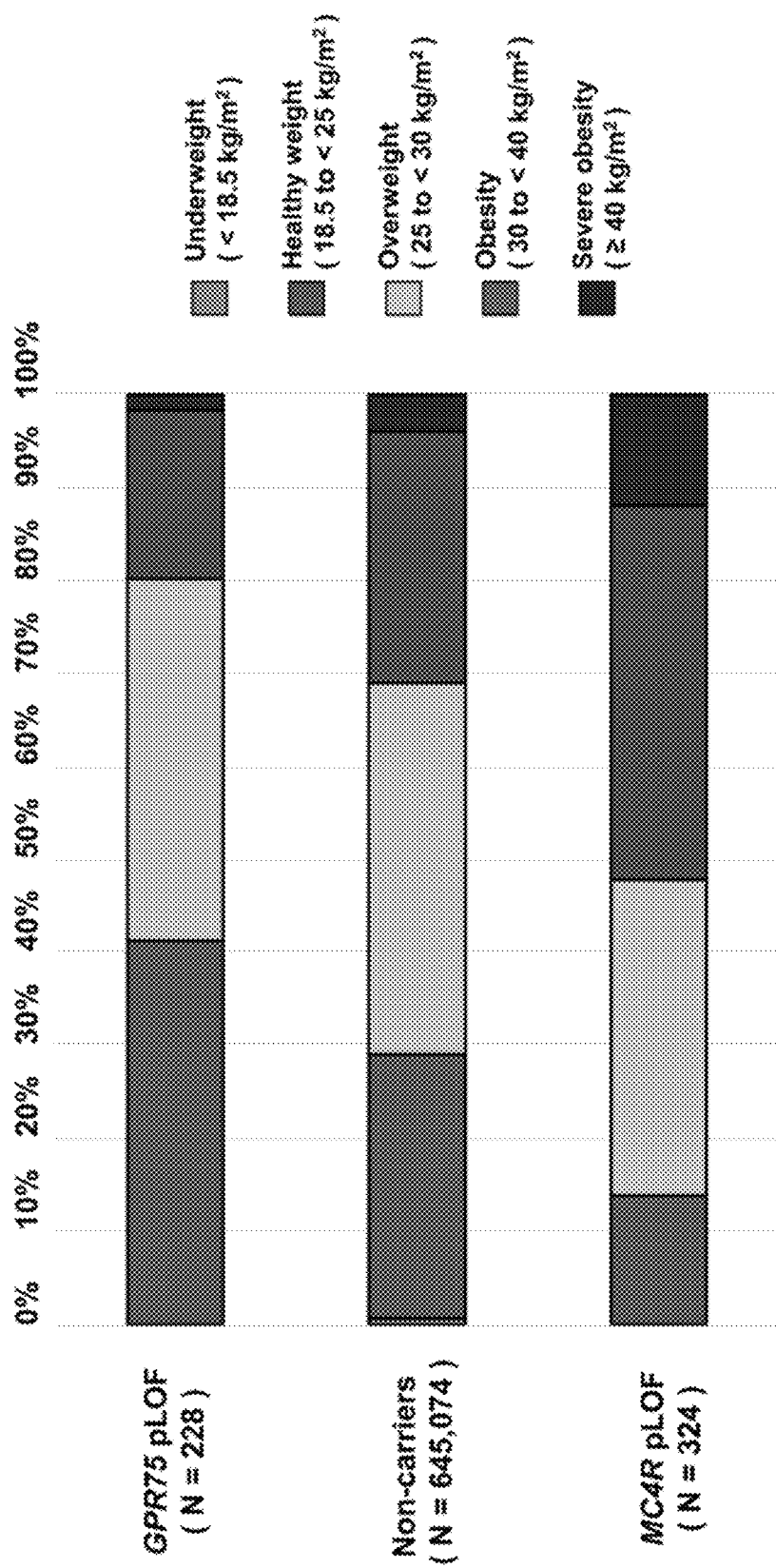
FIG. 7 shows distribution in body mass index categories for carriers and non-carriers of predicted loss-of-function variants in GPR75 or MC4R. Distribution of heterozygous carriers of predicted loss of function genetic variants in GPR75 (top), non-carriers (middle) and heterozygous carriers of predicted loss of function genetic variants in MC4R (bottom) in body mass index categories according to the World Health Organization's classification in the UKB, GHS and MCPS cohorts.

The association with lower BMI was directionally consistent and statistically significant in each of the constituent cohorts of the discovery meta-analysis (FIG. 2), as well as within age and sex subgroups (FIG. 5). The association of GPR75 pLOF variants with lower BMI was further corroborated in a combined analysis including an additional 91,328 individuals not included in the discovery set (per-allele beta in standard deviation (SD) units of BMI in the meta-analysis of discovery and additional cohorts, −0.34, 95% confidence interval (CI), −0.45, −0.22, $p=6.9\times10^{-09}$; FIG. 4B). This strong association with lower BMI was accompanied by a corresponding association with protection against obesity. Heterozygous carriers of GPR75 pLOF variants had 54% lower odds of obesity compared to non-carriers in a meta-analysis of the UKB, GHS and MCPS cohorts (FIG. 6; per-allele odds ratio, 0.46, 95% confidence interval, 0.31, 0.67, $p=6.9\times10^{-05}$) and their distribution across BMI categories was dramatically shifted towards lower BMI categories (FIG. 7). In UKB, GPR75 pLOF carriers were more likely to self-report a thinner than average comparative body size at age 10 compared to non-carriers (FIG. 8).

Figure 9:
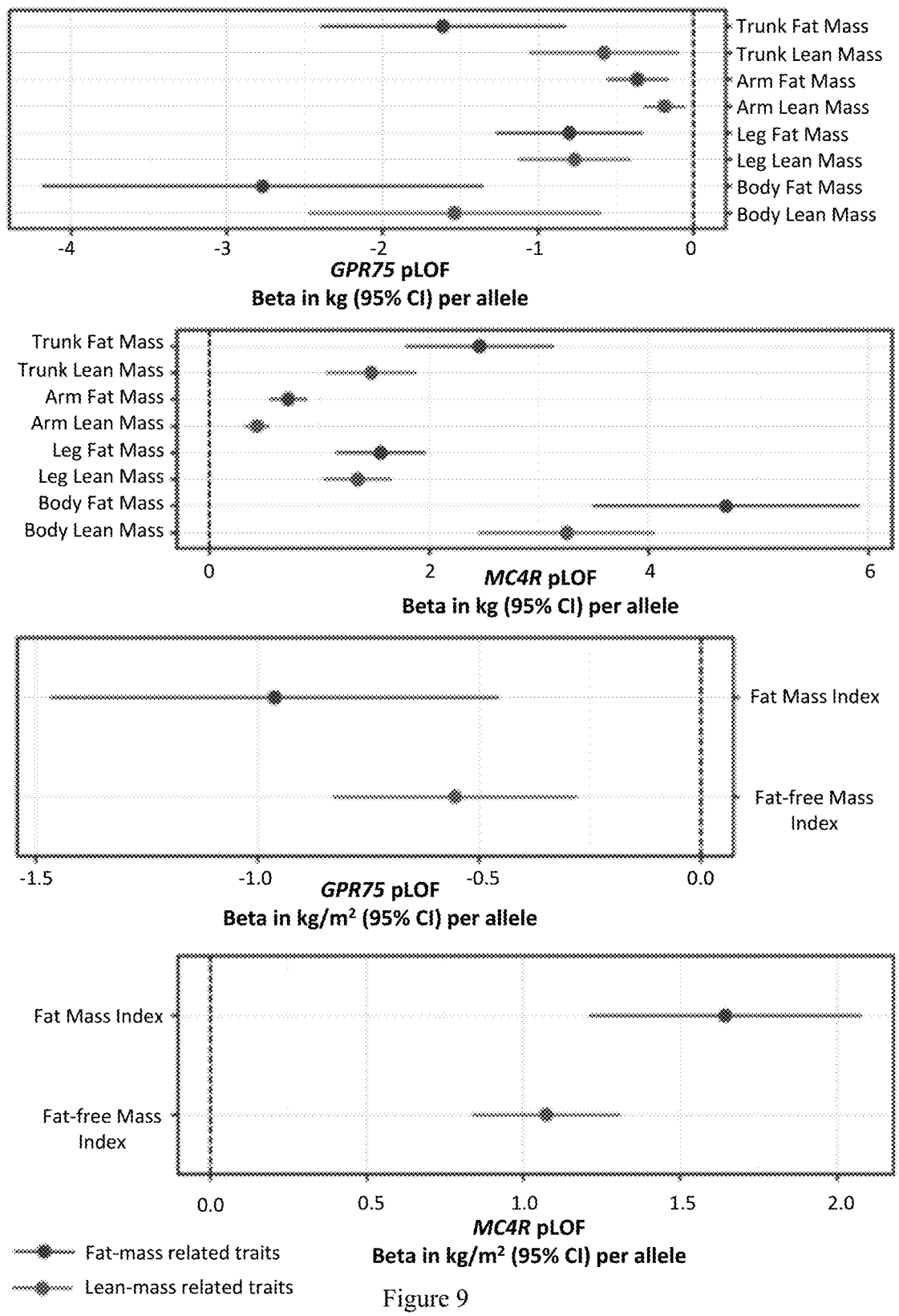
FIG. 9 shows association of pLOF variants in GPR75 and MC4R with body fat and lean mass indices estimated by bioelectrical impedance. Association analyses were performed in 423,418 participants of the UK Biobank study who underwent whole exome sequencing and bioelectrical impedance measurements. Abbreviations: pLOF, predicted loss of function; kg, kilograms; CI, confidence interval.

Body composition analysis with bioimpedance in UKB showed that the association with lower BMI was driven by an association with lower overall body fat mass and lower body fat percentage (FIG. 9). In an agnostic phenome-wide analysis of GPR75 pLOF variants (Example 1), statistically-significant associations with common diagnoses or measured continuous traits after correction for the number of statistical tests performed (2,173 phenotypes tested; Bonferroni-corrected p-value threshold, $p<2.3\times10^{-05}$), reflecting the rarity of these variants and the stringent multiple test correction, was not observed.

A detailed analysis of metabolic traits revealed a nominally-significant association (IVW meta-analysis $p<0.05$) with higher high-density lipoprotein cholesterol, which is consistent with a favorable metabolic profile (FIG. 10). Carriers of pLOF in GPR75 had lower odds of type 2 diabetes compared to non-carriers (63,492 cases and 549, 961 controls; per-allele odds ratio, 0.92; 95% confidence interval, 0.59, 1.45; p=0.73; FIG. 10), but the difference was not statistically significant. Exome sequencing association statistics was interrogated from up to 20,791 type 2 diabetes cases and 24,440 controls included in the T2D Knowledge Portal (world wide web at "t2d.hugeamp.org/"; Accessed Jan. 8, 2021), and similarly observed numerically lower odds of type 2 diabetes in carriers of GPR75 pLOF variants (odds ratio for type 2 diabetes, 0.52, 95% CI, 0.14 to 1.97;

p=0.30; alternative allele frequency, 0.03%). Due to the rarity of pLOF variants in GPR75 and given the genetic relationship between BMI and type 2 diabetes, it is estimated that millions of people would need to be sequenced to detect an association at p<0.05 (FIG. 10). An analysis for HbA1c, a continuous biomarker of glycemic levels, led to similar results (FIG. 10).

Figure 11:
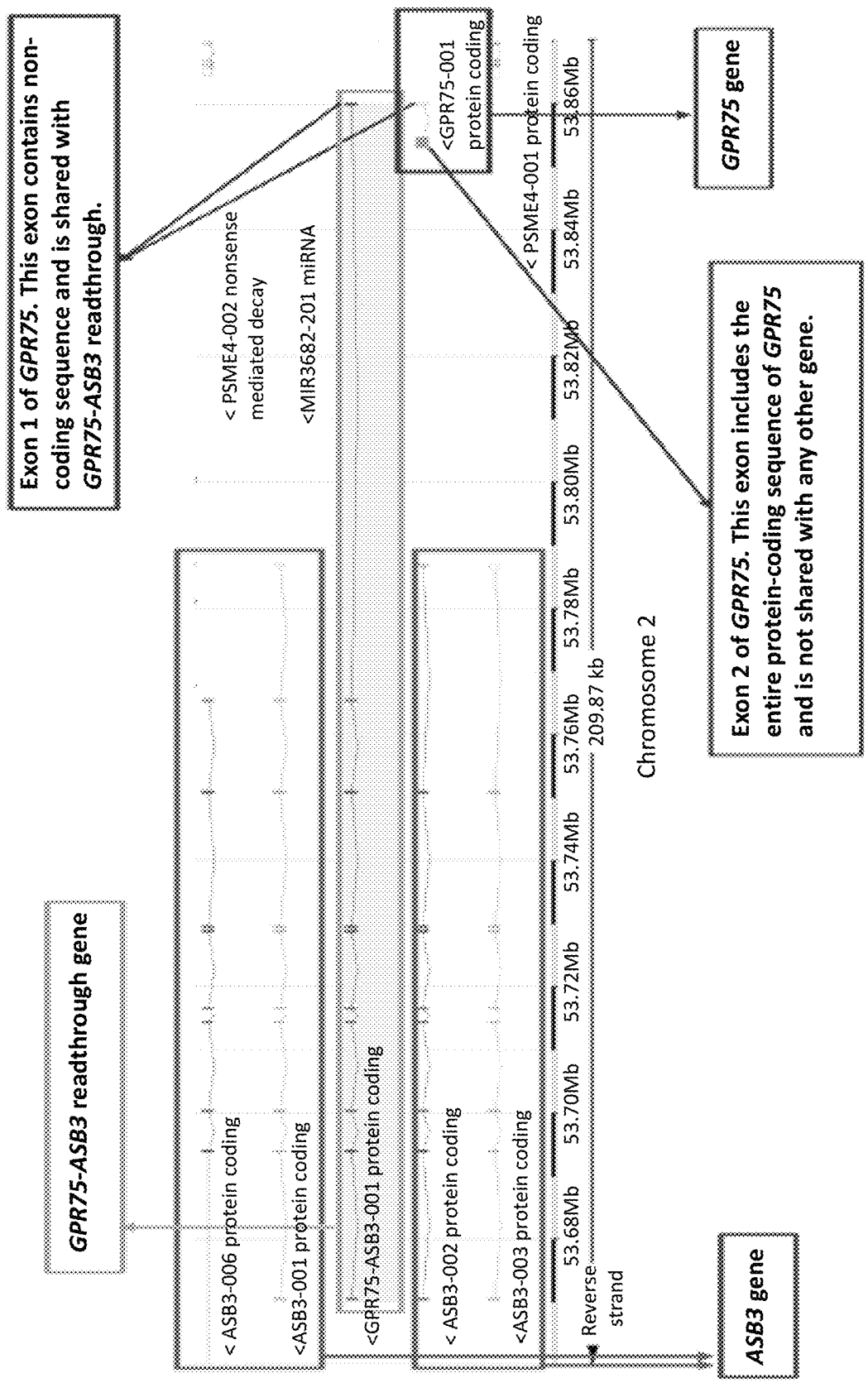
FIG. 11 shows GPR75, ASB3 and GPR75-ASB3 genes. The figure shows the gene model and chromosomal locations for the GPR75, GPR75-ASB3 and ASB3 genes. GPR75 shares exon 1, containing non-coding sequence, with the GPR75-ASB3 readthrough gene. Exon 2 of GPR75, containing its entire coding sequence, is exclusive to the GPR75 gene and is not shared with any other gene. ASB3 and GPR75-ASB3 share several exons with each other but not with GPR75. The underlying representation is from Ensembl region plot (Version 85).

Example 3: The Association with Lower Adiposity for Rare Protein-Truncating Variants can be Confidently Attributed to the GPR75 Gene The genomic context of the BMI association for pLOF variants in GPR75 was examined. The first and smallest exon of GPR75, containing untranslated sequence, is included in both GPR75 and in a putative GPR75-ASB3 readthrough gene with the nearby Ankyrin Repeat and SOCS Box Containing 3 (ASB3; FIG. 11). The second and final GPR75 exon (containing the entire translated region of GPR75) is not shared with any other gene or transcript (FIG. 11). A number of analyses was conducted to ensure that the association of pLOF variants could be firmly attributed to the GPR75 gene. First, 45 of the 46 pLOF variants in GPR75 that contributed to the association with lower BMI were located in exon 2 (FIG. 12), which is exclusive to the GPR75 gene (FIG. 11). Accordingly, the burden genotypes for pLOF variants in GPR75 had no linkage disequilibrium (LD; $R^2<0.0001$) with the burden genotype for pLOF variants affecting the GPR75-ASB3 readthrough gene or the ASB3 gene. Second, the association with BMI of the burden of rare coding variants in ASB3 or in the GPR75-ASB3 readthrough gene in the large exome sequencing meta-analysis was estimated. There was no association with BMI for the burden of rare nonsynonymous variants in ASB3 or GPR75-ASB3 across multiple statistical models with different variant annotation and allele frequency inclusion criteria (FIG. 13), including a lack of association for pLOF variants in either ASB3 or GPR75-ASB3 (FIG. 13). Finally, the association with BMI for the burden of rare pLOF variants in GPR75 conditional upon ASB3 and GPR75-ASB3 genotypes was estimated. The association of GPR75 pLOF variants with lower BMI was unaffected by adjusting for ASB3 and GPR75-ASB3 genotypes (FIG. 14). Therefore, the association with lower BMI for rare pLOF variants in GPR75 can be confidently attributed to the GPR75 gene.

Figure 16:
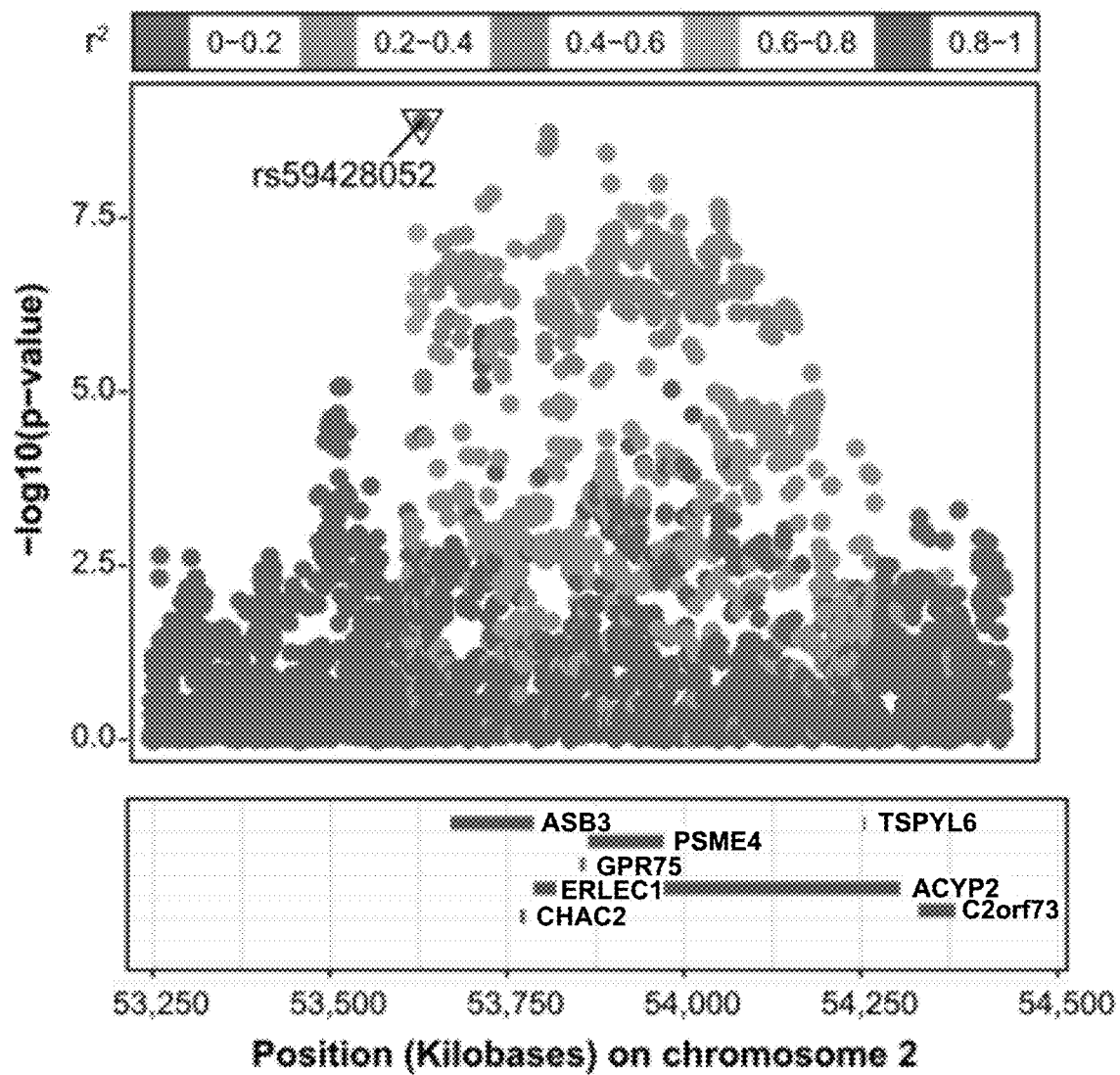
FIG. 16 shows associations with BMI for common variants at the GPR75 locus. Results from GWAS analyses of common imputed variants in European ancestry individuals from UKB and GHS are shown in the left panel and those from GWAS analyses in admixed Americans from the MCPS cohort in the right panel. The sentinel variant in the GWAS of European individuals (r559428052) is highlighted in the left panel. There were no genome-wide significant associations in Admixed Americans ($p<5\times10^{-8}$).
Figure 16:
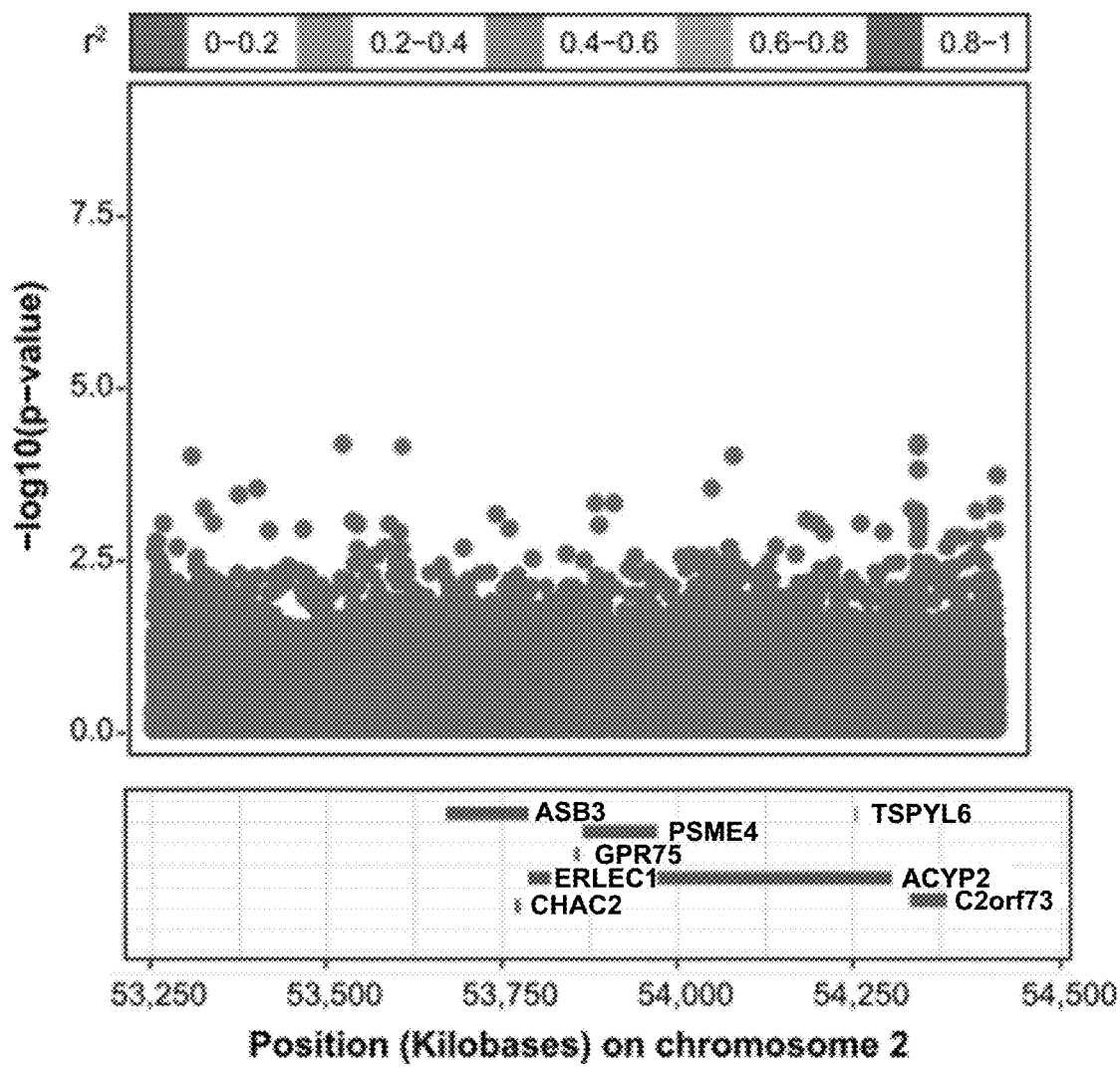

It was also explored whether there were common variant associations in the locus. In the 1 Mb window surrounding GPR75 (500 kb either side of the gene), there were 26 common variants associated with BMI at the genome-wide level of statistical significance (IVW meta-analysis, $p<5\times10^{-08}$) in the GWAS of imputed common variants in Europeans (FIG. 15 and FIG. 16), while there were no genome-wide significant associations in admixed Americans (FIG. 16). These 26 variants all fine-mapped to a signal led by rs59428052 (G-allele frequency, 14.7%; posterior probability of causal association, 30.4%; per-allele beta in SD units of BMI, −0.015; 95% confidence interval, −0.020 to −0.010; $p=1.3\times10^{-09}$, which is an intergenic variant nearest to ASB3 and approximately 200 kb downstream of GPR75. The rs59428052 variant did not co-localize with any eQTL signal nor were any of the additional 25 variants at the locus in LD ($R^2>0.8$) with any sentinel eQTLs in GTEx v8 (FIG. 14). Two of the 26 variants were in LD with a missense variant in ASB3 and GPR75-ASB3 (r536020289), which does not affect the GPR75 transcript (FIG. 14).

A formal conditional analysis was performed adjusting for the 26 common variants associated with BMI in the region and identified that the association with lower BMI for pLOF variants in GPR75 remains unchanged (FIG. 14). Therefore, the association with lower BMI for rare pLOF variants in GPR75 is independent of any of the 26 common variants associated with BMI at the locus in Europeans.

In summary, the human genetic analysis at the locus indicates that: a) rare pLOF variants in GPR75 are associated with lower BMI with a large effect association, b) the pLOF association is attributed to GPR75 and not to other nearby transcripts, cc) the signal is independent of BMI-associated common variants in the region, and d) the small-effect intergenic common variant signal found in that region by GWAS fine-mapping in Europeans has no apparent link with GPR75.

Example 4: Loss-of-Function Variants in GPR75 Associated with Lower Body Adiposity Results in Intracellular Retention of a Truncated GPR75 Receptor The association with lower BMI for pLOF variants in GPR75 was due to multiple independent rare pLOF variants predicted to truncate GPR75 at different locations (FIG. 4A and FIG. 12). Due to their rarity, none of the 46 rare pLOF variants found by exome sequencing in the analysis were well ascertained by array-genotyping or imputation (FIG. 12). Leave-one-out analyses showed that the burden signal was robust to the exclusion of one pLOF variant at a time (FIG. 17). Out of 46 rare pLOF variants in GPR75, five were individually associated with lower BMI at a nominal level of statistical significance (IVW meta-analysis p<0.05; Ala110fs; Ser219fs; Gln234*; Cys400fs, Lys404*; FIG. 18), while none was associated with higher BMI. When excluding all 5 of these variant sites from analysis, the remaining set of pLOF variants was still associated with lower BMI (FIG. 17).

Figure 19:
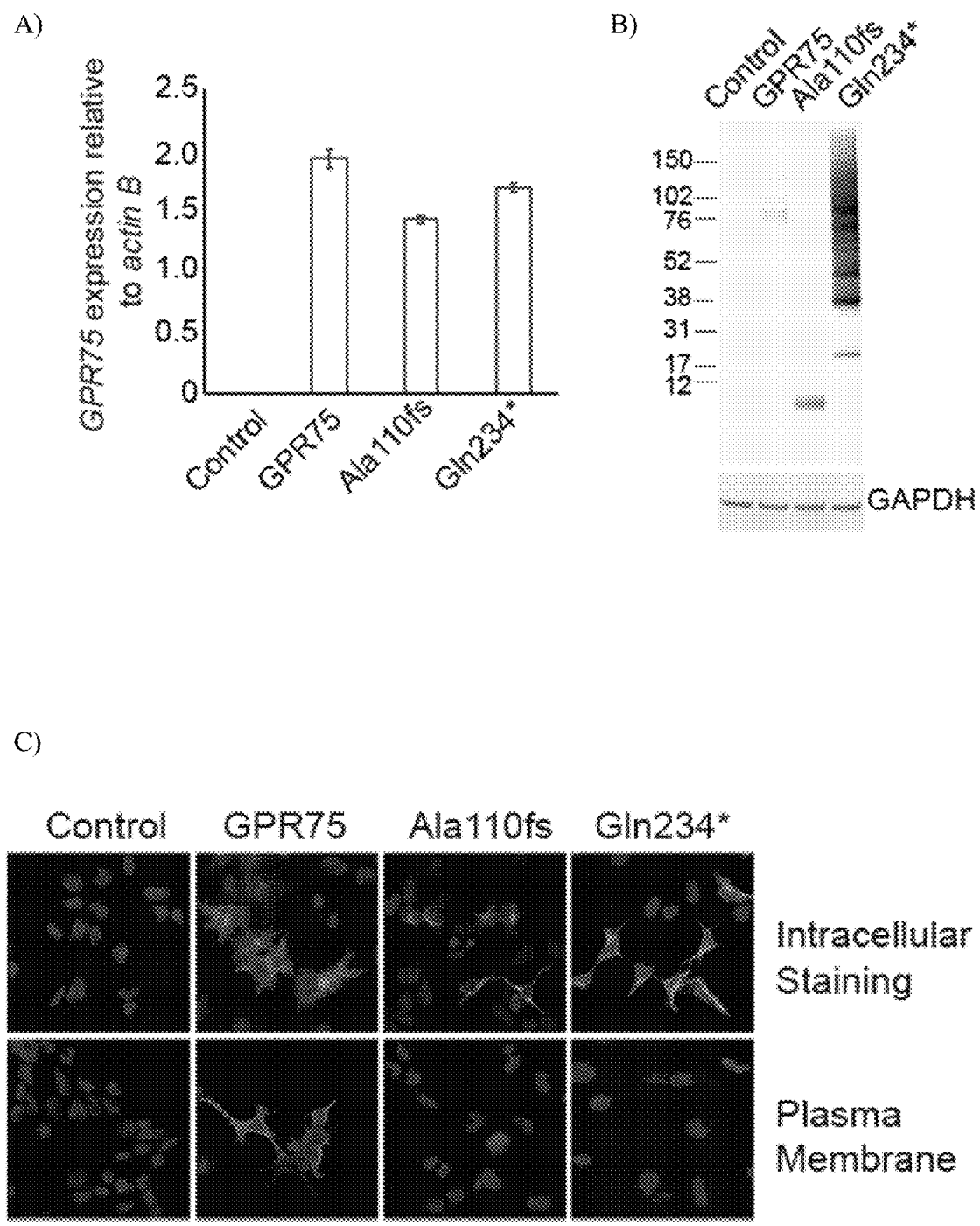
FIG. 19 shows in vitro expression studies of two predicted loss-of-function genetic variants in GPR75. Panel A shows results of quantitative reverse transcription polymerase chain reaction experiments which measured GPR75 mRNA levels. Expression of GPR75 was calculated relative to the beta-actin gene. Values represent the mean and standard deviation of 3 technical replicates representative of 1 of 3 biological replicate experiments performed for each condition. Panel B shows Western blotting analysis of GPR75 protein levels. GPR75 Ala110fs and Gln234* protein products correspond to the predicted molecular weight of 14 and 25 kDa, respectively. The results are representative of 3 biological replicates. Panel C shows immunofluorescence staining experiments describing the cellular localization of GPR75. The top images show intracellular staining achieved by membrane permeabilization, while the bottom images show plasma membrane localization (non-permeabilized cellular membrane). Panel D shows flow cytometry analysis of the cell surface expression of GPR75. Identified cell populations are presented in percent (%) of live HA-TAG GPR75 positive cells. Values represent the mean of 4 biological replicates per condition and their standard deviation. All experiments were performed in HEK293 cells that were transfected with green fluorescent protein control plasmids (Control), GPR75-wildtype (GPR75), GPR75-Ala110fs or GPR75-Gln234* plasmids. Abbreviations: SSC, side scatter; HA, hemagglutinin tag.

The two most frequent (minor allele count ≥10) amongst the pLOF variants individually associated with BMI expressed in vitro showed that they result in cellular retention of a truncated receptor likely leading to a complete loss of function (FIG. 19).

It is predicted that that the loss of a functional copy (i.e., haploinsufficiency) or production of a truncated protein that disrupts receptor multimers (i.e., dominant negative effects) may explain the association of GPR75 truncation with lower BMI. It is hypothesized that in the case of haploinsufficiency the earlier N-terminal truncation of GPR75 would result in greater phenotypic impact than a C-terminal truncation within the last intracellular domain. Genetic variants resulting in truncation of GPR75 before the final intracellular domain were associated with −2.1 kg/m² lower BMI (IVW meta-analysis $p=4.1\times10^{-07}$) as compared with −1.4 kg/m² lower BMI (IVW meta-analysis p=0.012) for variants resulting in truncation within the final domain (FIG. 20). This difference was even more pronounced for truncations within the last 100 amino-acids of the final C-terminal domain (FIG. 20).

Figure 22:
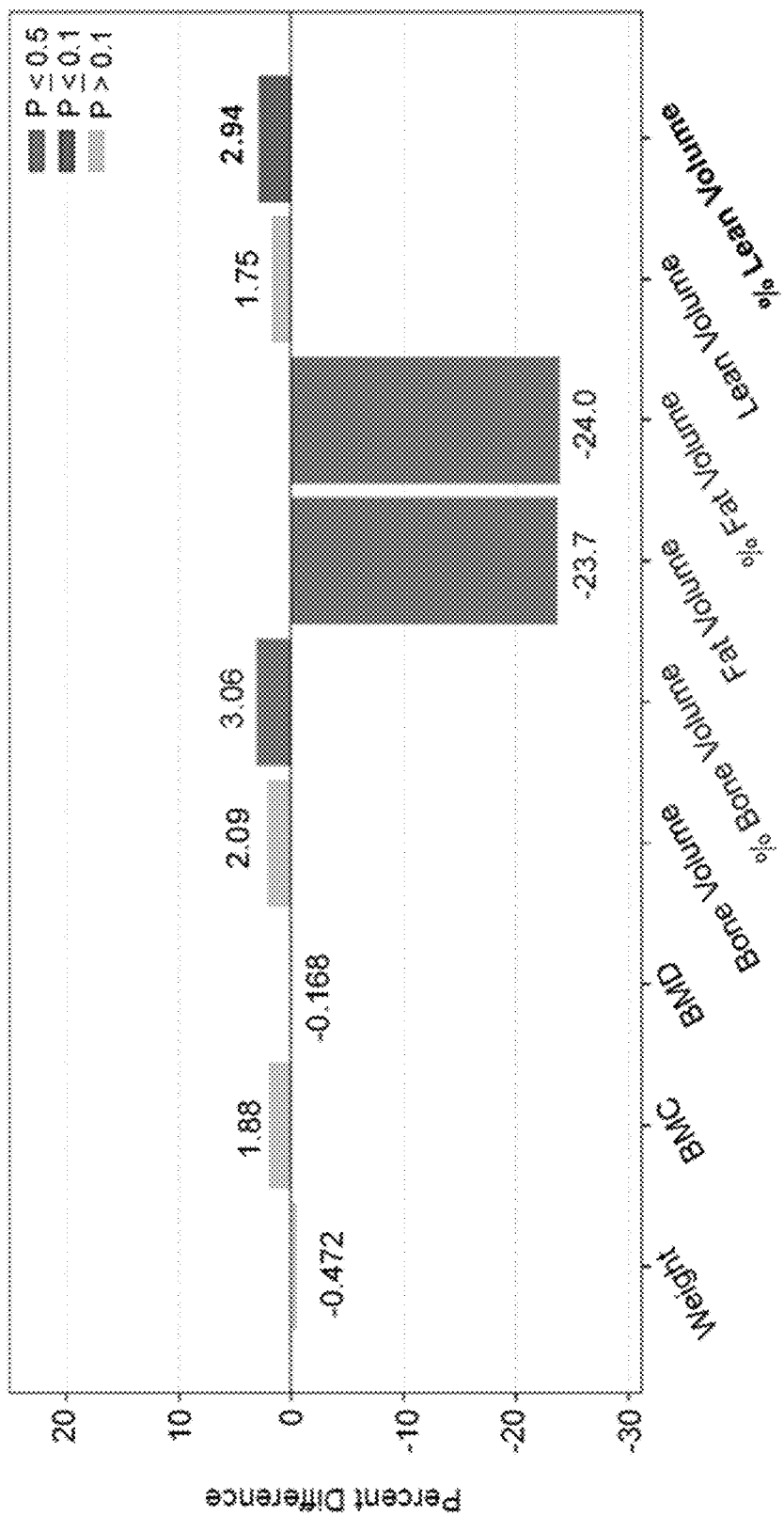
FIG. 22 shows percentage difference of body composition of male homozygote knockouts (designated with KO) compared to wild type. BMC, bone mineral content; BMD, bone mineral density; P, p-value.
Figure 23:
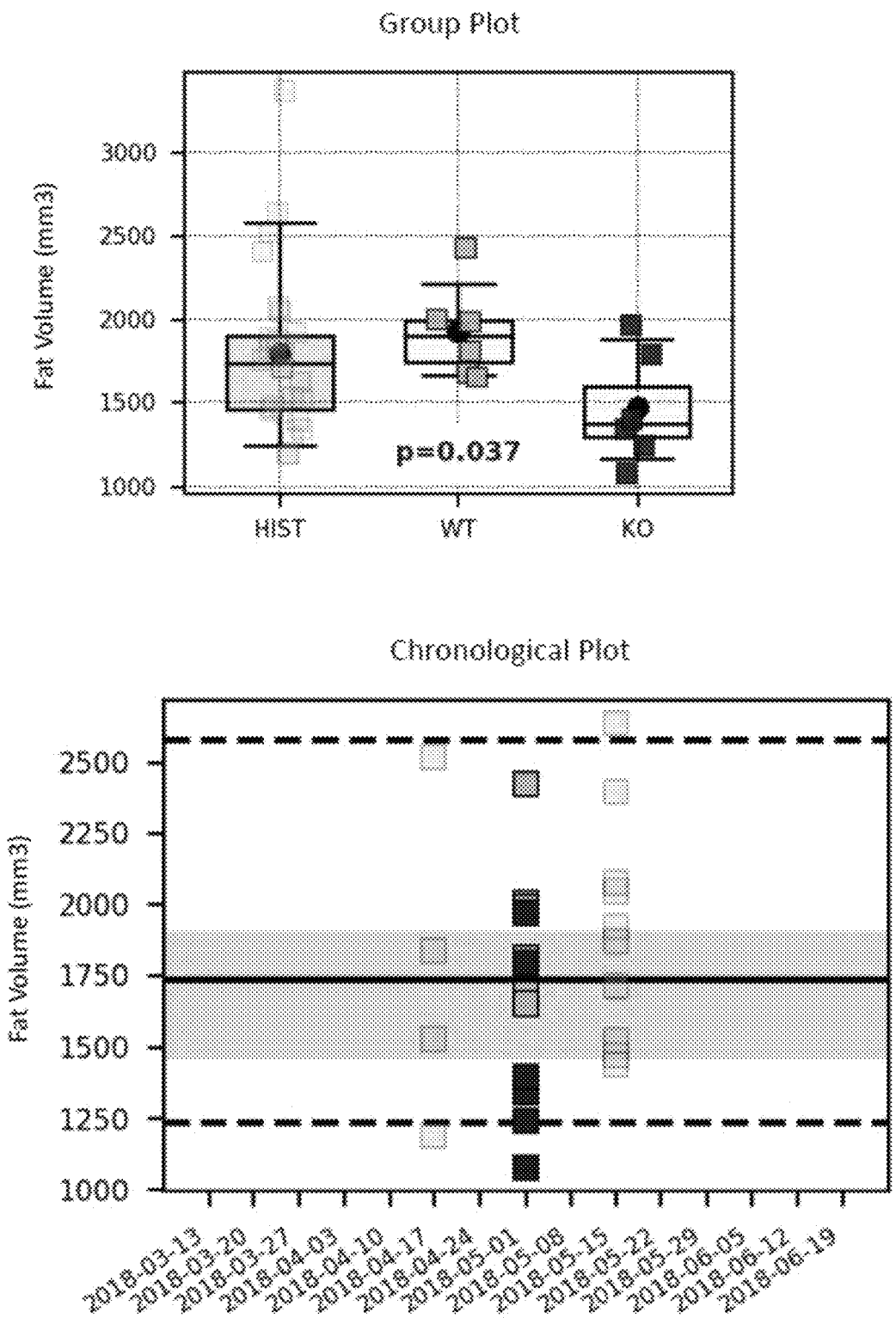
FIG. 23 shows average fat volume and percent fat volume of GPR75 WT (HIST and WT) and homozygote knockouts (designated with KO) male mice.
Figure 23:
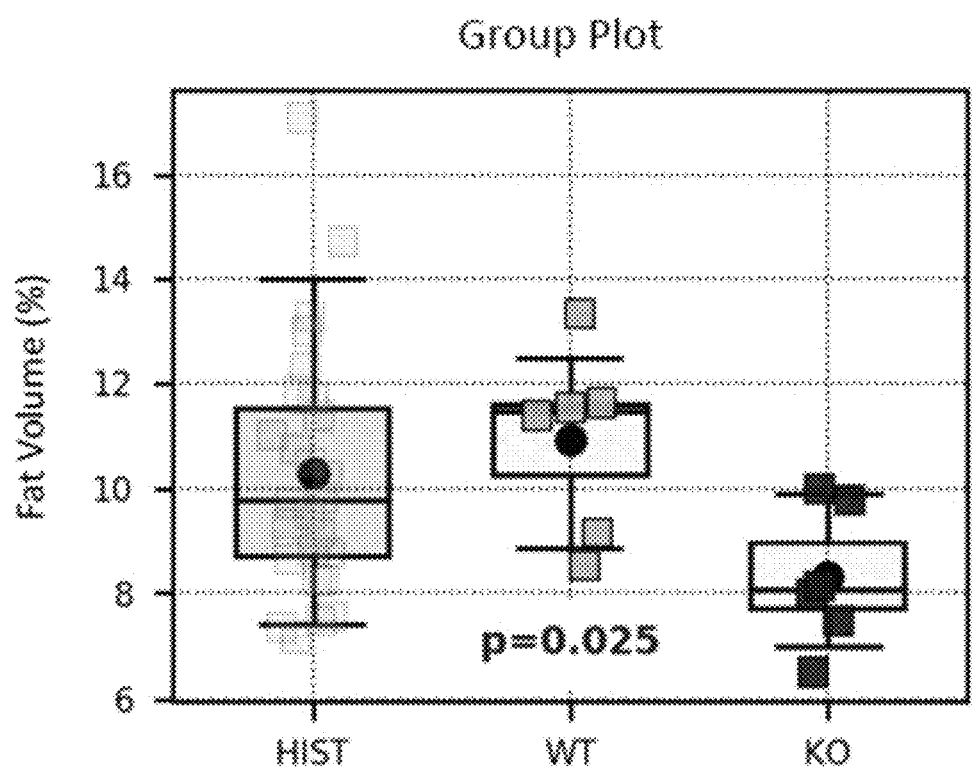
Figure 23:
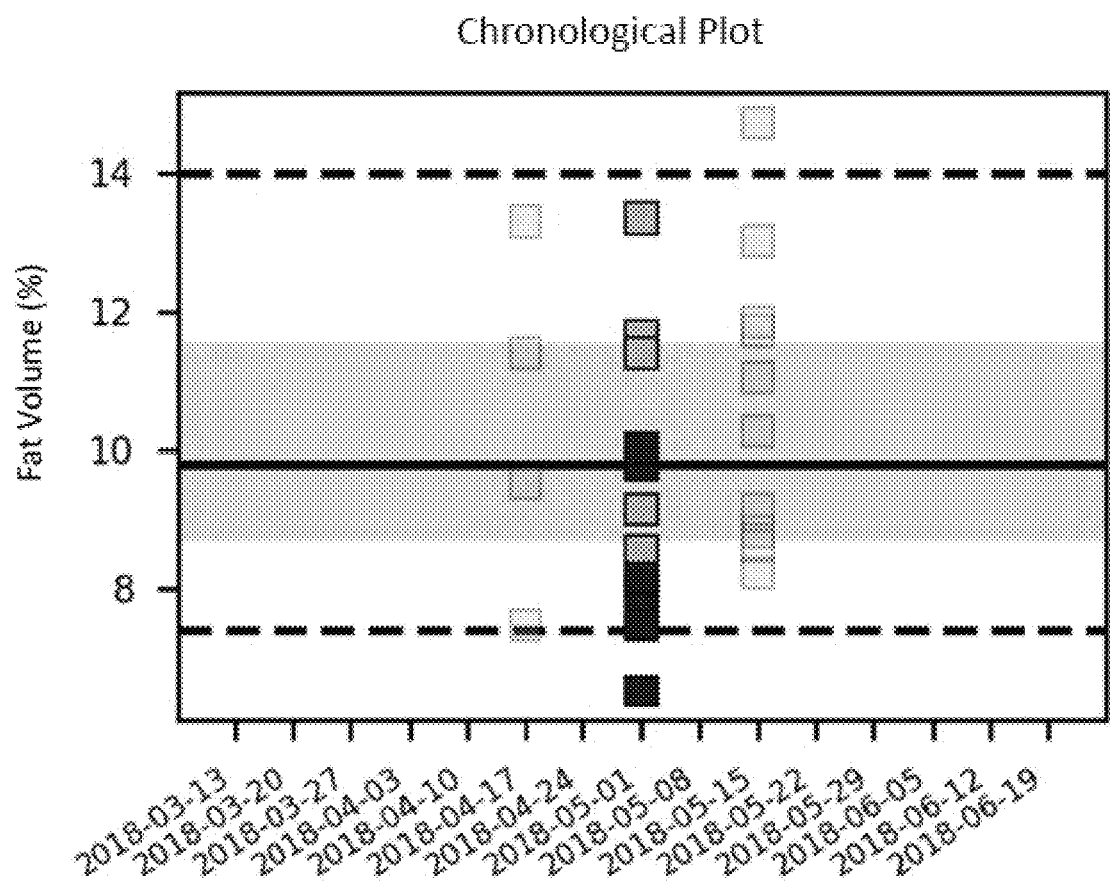

Example 5: Gpr75 Deletion in High-Fat Diet Induced Obesity and its Glycemic Consequences in Mice GPR75-KO male mice displayed 7% lower body weight compared to wild-type (FIG. 21). In contrast, no significant difference was observed in female mice (FIG. 21). A more detailed body composition analysis of GPR75-KO mice is summarized in FIG. 22. Gpr75 KO mice had 24% lower fat volume and percent fat compared to wild-type (FIG. 22 and FIG. 23), a statistically significant difference.

Figure 25:
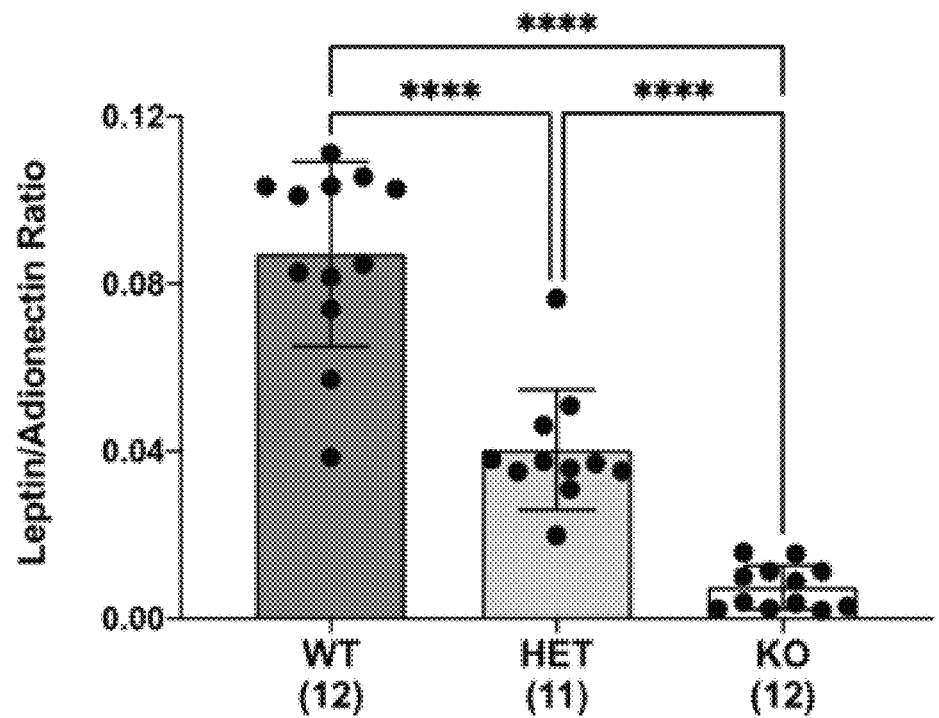
FIG. 25 shows plasma leptin, adiponectin and leptin-adiponectin ratio in mouse experiments. Panel A shows plasma leptin levels in Gpr75$^{+/+}$ (WT), Gpr75$^{+/-}$ (HET), and Gpr75$^{-/-}$ (KO) mice after the high-fat diet challenge expressed as fold difference compared to wild-type (set as 1). Absolute levels (mean±standard deviation) for wild-type mice were 208±42 pg/mL. Panel B shows plasma adiponectin levels in Gpr75$^{+/+}$ (WT), Gpr75$^{+/-}$ (HET), and Gpr75$^{-/-}$ (KO) mice after the high-fat diet challenge expressed as fold difference compared to wild-type (set as 1). Absolute levels (mean±standard deviation) for wild-type mice were 3,911±1,656 ng/mL. Panel C shows ratio of leptin to adiponectin in Gpr75$^{+/+}$ (WT), Gpr75$^{+/-}$ (HET), and Gpr75$^{-/-}$ (KO) expressed in ratio units. Number of mice included in each group and analysis are in parenthesis in the x-axis labels. Results are presented as mean±standard deviation. ns, not statistically-significant; *p<0.05, p<0.01, *p<0.001, ****p<0.0001 by two-way ANOVA with Tukey's multiple comparisons test.

In a mouse model of high-fat diet (HFD) induced obesity, experimental deletion of Gpr75 protected against weight gain and its associated abnormalities in glucose and insulin metabolism (FIG. 24). When placed on HFD for 14 weeks, $Gpr75^{+/+}$ mice approximately doubled their weight. Body weight changed from an average (standard deviation) of 20.9 (2.1) to 43.3 (6.5) grams (body weight change, +22.4 grams). In contrast, mice with a genetic deletion of Gpr75 gained less weight in an allele-dose dependent fashion (body weight change +16.9 grams, difference in weight-change with wild-type −5.5 grams or −25% for $Gpr75^{+/-}$ mice; body weight change +12.6 grams, difference in weight-change with wild-type −9.8 grams or −44% for the $Gpr75^{-/-}$ mice; FIG. 24A). Increases in fasting blood glucose seen with HFD in $Gpr75^{+/+}$ mice were reduced in an allele-dose dependent manner in $Gpr75^{-/+}$ and $Gpr75^{-/-}$ mice (FIG. 24B). Mice with a genetic deletion in Gpr75 were also resistant to HFD-induced impairments in glucose tolerance and insulin sensitivity (FIG. 24C and FIG. 24D). At the end of 14 weeks of HFD, plasma leptin levels were lower in $Gpr75^{-/-}$ and $Gpr75^{+/-}$ mice compared to wild-type mice (FIG. 25A), whereas adiponectin levels were higher resulting in a 2- and 10-fold lower leptin to adiponectin ratio in $Gpr75^{+/-}$ and $Gpr75^{-/-}$ mice compared to wild-type (FIG. 25B and FIG. 25C).

Further analyses in a distinct set of experiments studied the effects of genetic deficiency of Gpr75 on body composition and blood glucose levels in addition to body weight in Gpr75+/+, Gpr75+/− and Gpr75−/− mice maintained on a chow diet or following a switch to a 60% high fat diet starting on week 0 for 9 weeks. Body weight was examined weekly. Blood glucose levels were measured at weeks −1, 4 and 8. Fat mass, lean mass and bone mass were quantified by micro-computed tomography (mCT) on weeks 0, 5 and 9.

Figure 26:
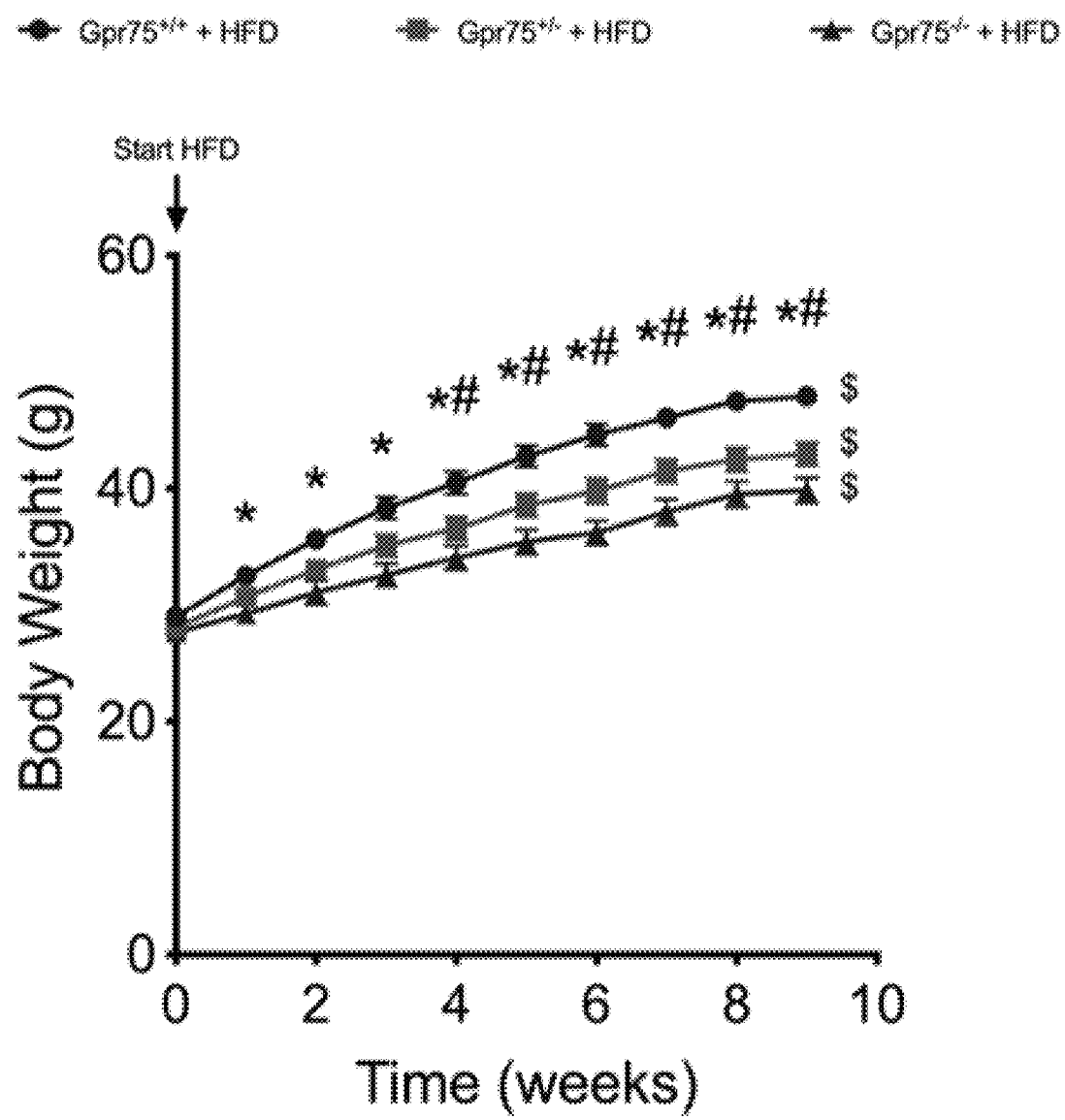
FIG. 26 shows body weight, fat mass, lean mass, bone mass, and blood glucose levels measured in high-fat diet mouse experiments. Body weight (Panel A), fat mass (Panel B, top), lean mass (Panel B, middle), bone mass (Panel B, bottom) and blood glucose levels (Panel C) for Gpr75$^{+/+}$, Gpr75$^{+/-}$ and Gpr75$^{-/-}$ mice (black circles, red squares and blue triangles, respectively) maintained on chow diet (week 0 or −1) and during 9 weeks of high fat diet feeding (HFD). *, P<0.05 for Gpr75$^{-/-}$ vs Gpr75$^{+/+}$ mice. #, P<0.05 for Gpr75$^{+/-}$ vs Gpr75$^{+/+}$ mice. $, P<0.05 for the last high fat diet data point vs the first data point obtained on chow diet prior to high fat diet feeding, for the respective genotype.
Figure 26:
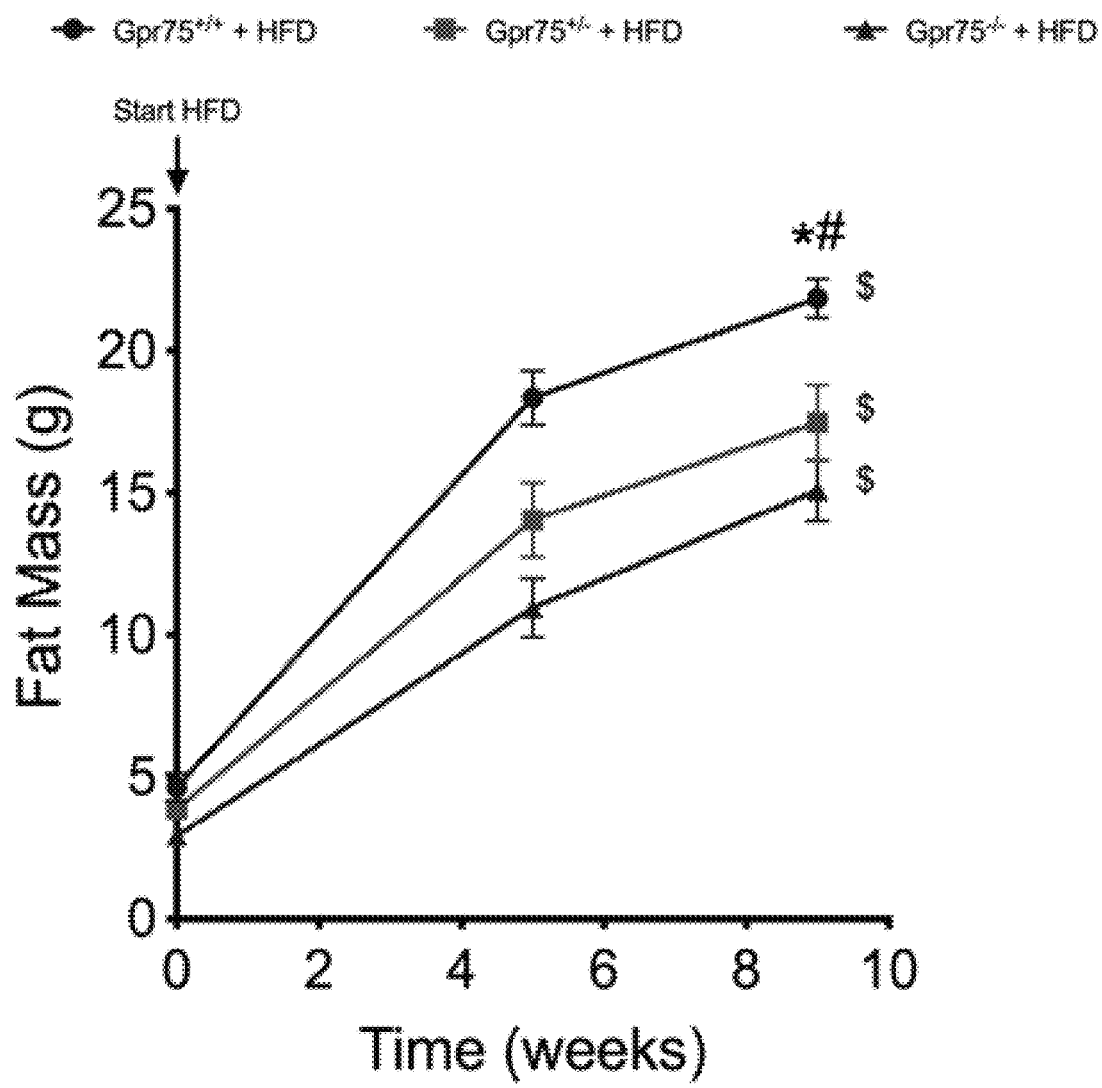
Figure 26:
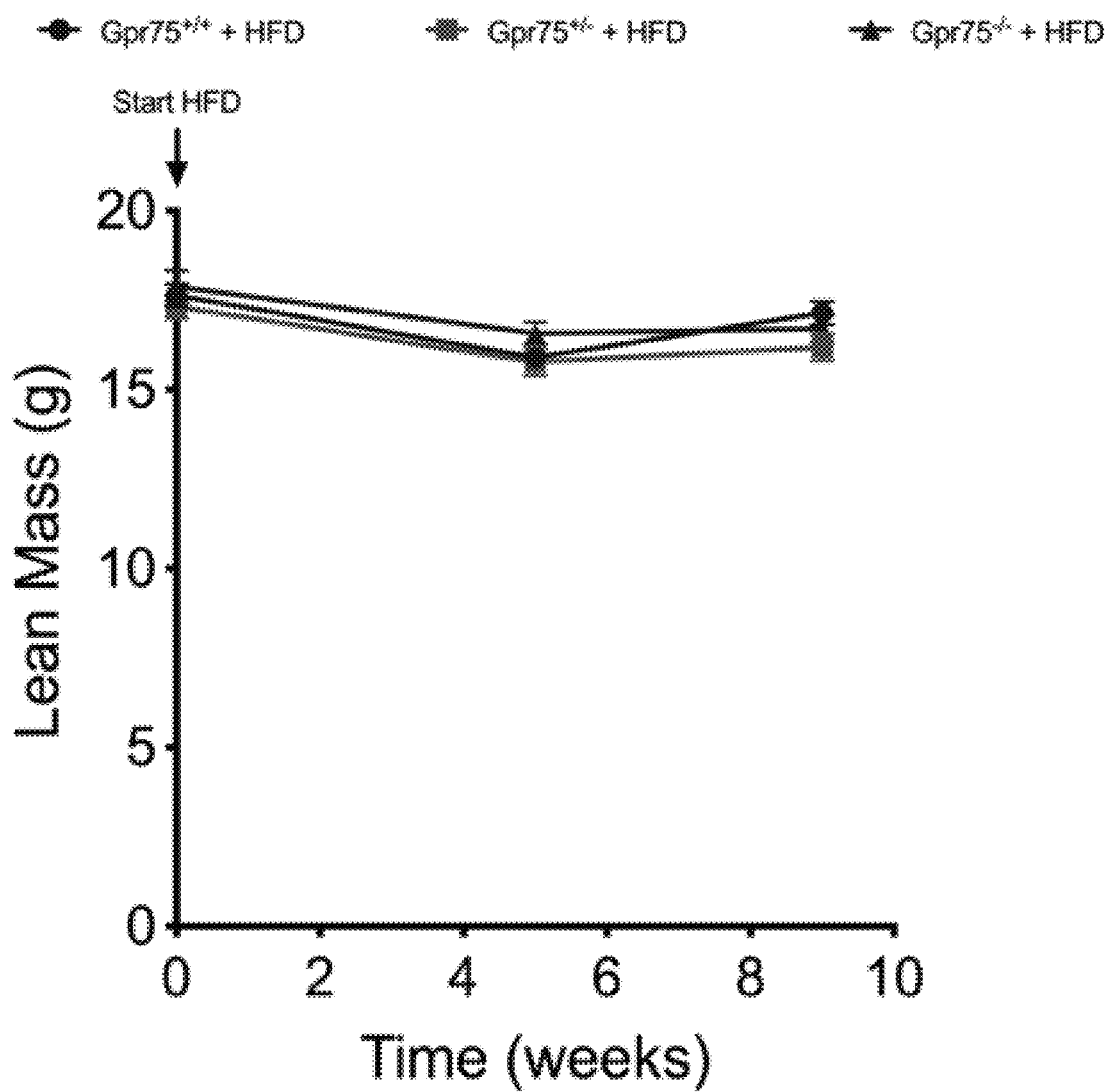
Figure 26:
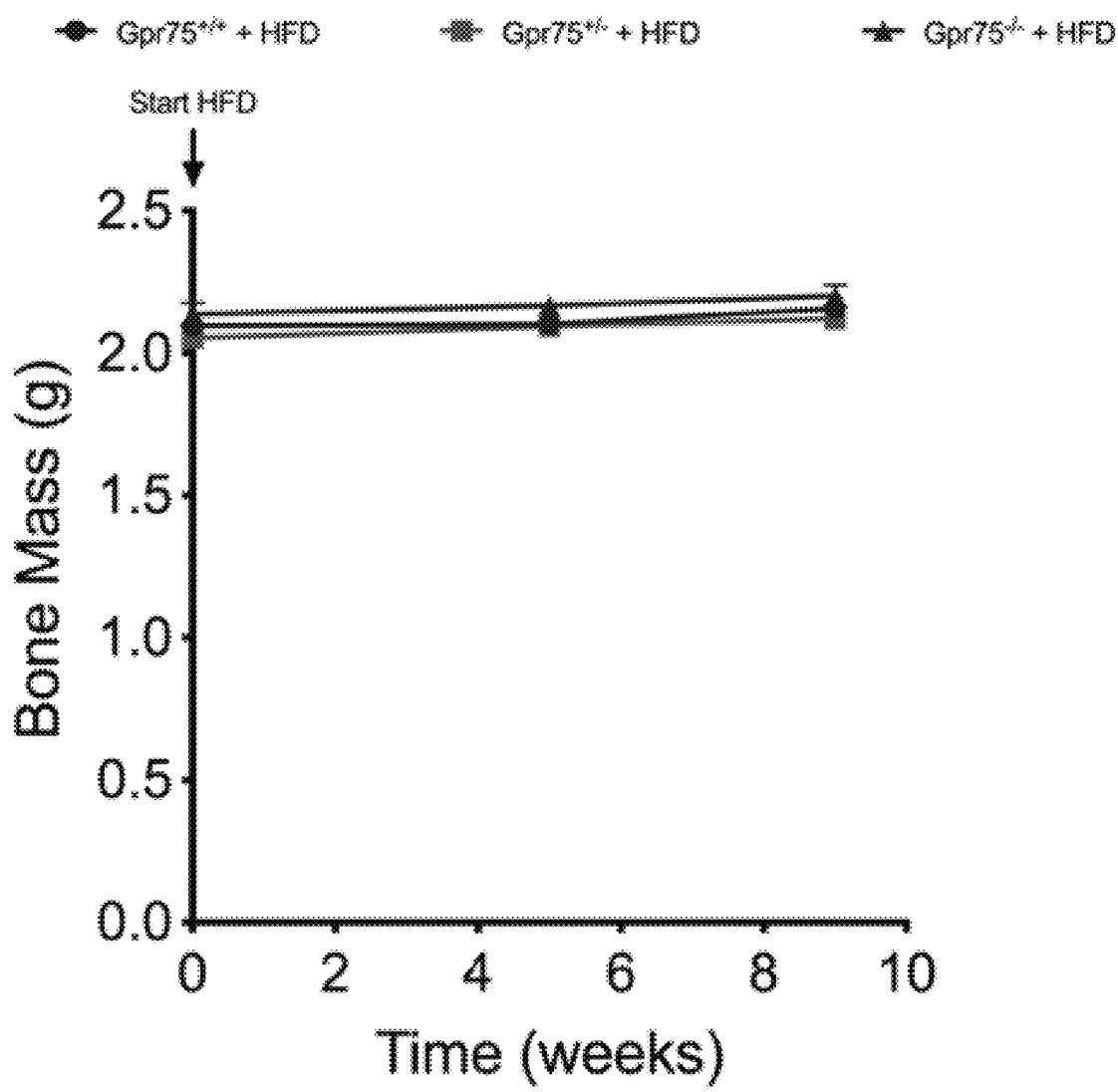
Figure 26:
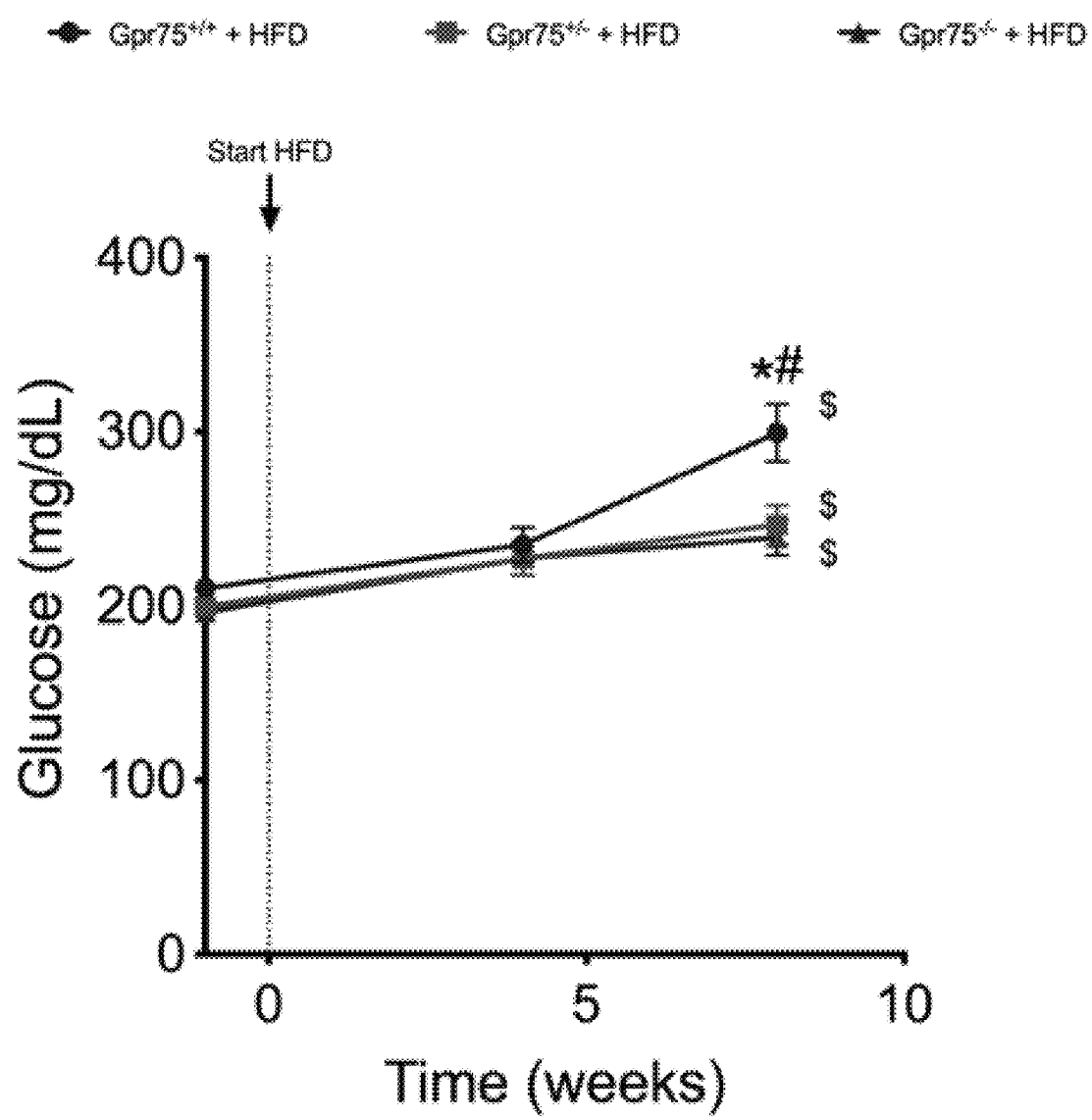

Prior to a switch from chow diet to high fat diet feeding, 10- to 15-week-old male $Gpr75^{+/+}$, $Gpr75^{+/-}$ and $Gpr75^{-/-}$ mice did not exhibit differences in body weight (week 0, FIG. 26, Panel A), lean mass (week 0, FIG. 26, Panel B), bone mass (week 0, FIG. 26, Panel B) or blood glucose levels (week −1, FIG. 26, Panel C). However, $Gpr75^{-/-}$ mice exhibited a significant reduction in fat mass when compared to $Gpr75^{+/+}$ and $Gpr75^{+/-}$ mice (FIG. 26, Panel B). After 9 weeks of high fat diet feeding $Gpr75^{+/+}$, $Gpr75^{+/-}$ and $Gpr75^{-/-}$ mice gained body weight relative to their body weight at week 0 (FIG. 26, Panel A). Following the switch to high fat diet feeding, the body weight of $Gpr75^{-/-}$ mice was significantly lower than $Gpr75^{+/+}$ mice starting at 1 week of high fat diet feeding thru to 9 weeks of high fat diet feeding (FIG. 26, Panel A). In addition, the body weight of $Gpr75^{+/-}$ mice was significantly lower than $Gpr75^{+/+}$ mice starting at 4 weeks of high fat diet feeding thru to 9 weeks mice (FIG. 26, Panel A). In summary, $Gpr75^{+/-}$ and $Gpr75^{-/-}$ mice show reduced body weight gain with high fat diet feeding.

Assessment of body composition by mCT, revealed that after 9 weeks of high fat diet feeding $Gpr75^{+/+}$, $Gpr75^{+/-}$ and $Gpr75^{-/-}$ mice gained fat mass relative to week 0. At 5 and 9 weeks post-high fat diet feeding, $Gpr75^{-/-}$ and $Gpr75^{+/-}$ mice exhibited less fat mass relative to $Gpr75^{+/+}$ mice (FIG. 26, Panel B). Lean mass and bone mass (FIG. 26, Panel B) were not significantly different amongst $Gpr75^{+/+}$, $Gpr75^{+/-}$ and $Gpr75^{-/-}$ mice after 5 and 9 weeks of high fat diet feeding. In summary, $Gpr75^{-/-}$ and $Gpr75^{+/-}$ mice show a reduction in fat mass gain with high fat feeding.

After 8 weeks of high fat diet feeding $Gpr75^{+/+}$, $Gpr75^{+/-}$ and $Gpr75^{-/-}$ mice showed significant increases in blood glucose levels relative to their blood glucose levels with chow diet feeding at week −1 (FIG. 26, Panel C). After 4 weeks of high fat diet feeding no differences in blood glucose levels were observed between $Gpr75^{+/+}$, $Gpr75^{+/-}$ and $Gpr75^{-/-}$ mice (FIG. 26, Panel C). However, after 8 weeks of high fat diet feeding, $Gpr75^{-/-}$ and $Gpr75^{+/-}$ mice exhibited significantly lower blood glucose levels than $Gpr75^{+/+}$ mice (FIG. 26, Panel C). These data suggest that $Gpr75^{+/-}$ and $Gpr75^{-/-}$ mice show protection from hyperglycemia associated with high fat diet feeding.

Figure 27:
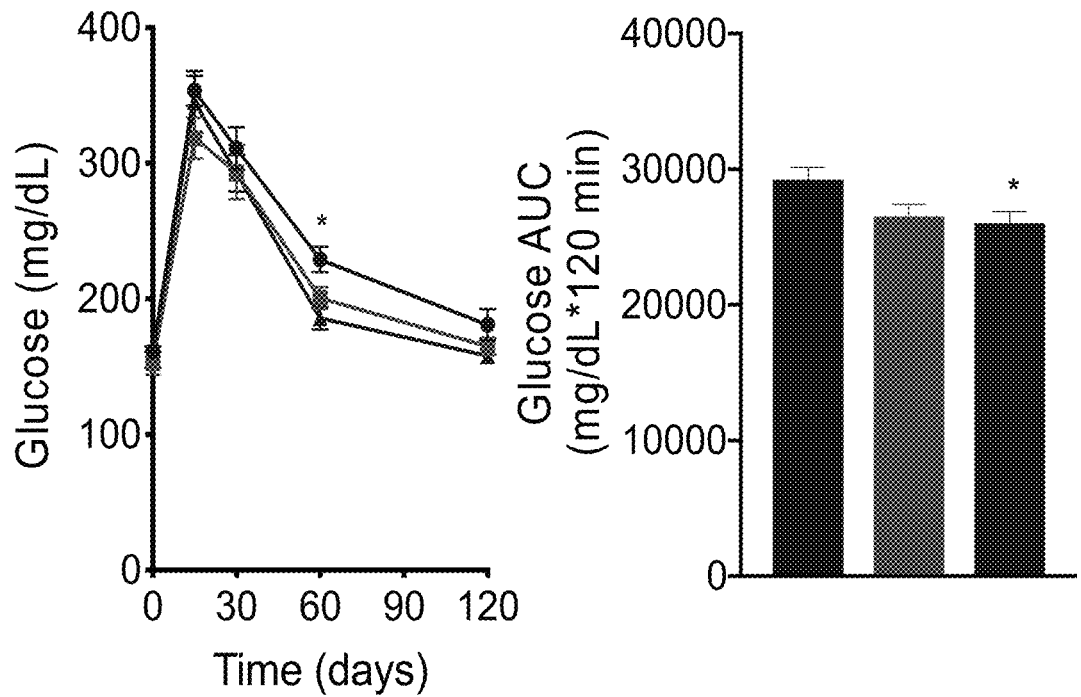
FIG. 27 shows chow-fed female Gpr75 knockout mice are not insulin resistant and exhibit improved glucose tolerance.

Example 6: Chow-Fed Female Gpr75 Knockout Mice are not Insulin Resistant and Exhibit Improved Glucose Tolerance An oral glucose tolerance test was performed on 13-week old female $Gpr75^{+/+}$, $Gpr75^{+/-}$ and $Gpr75^{-/-}$ mice. Animals were fasted at 7 a.m. for 4 hours, and then were given a 2 g/kg dose of dextrose (Hospira, Inc, NDC 0409-6658-02)) via oral gavage at 11 a.m. Glucose measurements were taken using an AlphaTRAK2 glucose meter (Zoetis, Cat #71676-01) and test strips (Zoetis, Cat #71681-01) at 0, 15, 30, 60, and 120 minutes post dextrose administration. Results are shown in FIG. 27.

Various modifications of the described subject matter, in addition to those described herein, will be apparent to those skilled in the art from the foregoing description. Such modifications are also intended to fall within the scope of the appended claims. Each reference (including, but not limited to, journal articles, U.S. and non-U.S. patents, patent application publications, international patent application publications, gene bank accession numbers, and the like) cited in the present application is incorporated herein by reference in its entirety and for all purposes.

SEQUENCE LISTING (1461 sequences)

SEQ ID NO: 1 - DNA, 7056 bp, homo sapien
gtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggtgagaggccgcgggcccctggaggaggacaaccccacgatgccggagacggctcccggaggctggcgggatagcgaggagcgcggctgcgctgggccaggcccggctccgcgtacctgtcttcctggtgcggcctgcagggtagccttctcgcccgtccctgccggttcccaggctctgctcggccgtggaaccccccccacccacccacccaccgcccctaccctggctgagccctcctaacccaccacccctctgcggcattcttttgcaagcttacctggcccggcctaggccctccttaccgtcacctcacccttctccgggaagcccctacccaccgccagcccctcacgggggggtcgaccttccctgcccgcagtttcccactctgtcctcaggctgggggctccctggcctcttcatccctcccatcaaatgactcaggtcttcccatcccattagctgctccgggttcaatgtagttctactggatagaaagagcaagggctttgaaatcagataatgaccttggggaagttatctaacctccctgaggttttcctgatcgatagaaatacaatgggaatcacaataatacagaaccttgctctctgtgaggattaggctttgaaaatgctaacctaagacattttggggcgcgcggggaatggggttggaagaattcaggtcgtgagttgatttatgaaagcccctatagcatgttttaatgttcactaaaaatttaaaacagcacactagatatatcagaggctgttcacatatcttaatgaaaaatcattgccactcaaattatacaataaattttcatccatattctttgcttgctagttacttcaggatgtctcatttgtaagaatatgcatgtgaattcattcttactgcagctaatatgcatgcttaagactggtgttccagcttaaaatctttctgattttgtgactttaatcacatcttctataacctattctccgtcccagagatgaagagtagcttgtatgtttgcattgcaaataacatgggtaatctttattgaatatttatgagtagcaaagcagtattaatttattccccttccaaaaccacttttattttctgccgtcatcatgtcattccaaattatggtcacagcctcctttttcttaaagtctcaggagttactactaagacctgagtttactttccctccattttcttgatttctgttatactaaagtttttctgcaaaccttttcgtcttttctgtcctctgctttttctcccttttctcttcccagcccatgattcctttttttctaattatctcaataggagtgatttatgattactttatatgtgaactacagttagatacatagaagaatgtgtgtgtgtgtgtgtgtgtgtgtgtgtgtgtgtgtgtgtctatctgtatctacatagatgtagatatagctatataggtgtatcagaatttcggattccagaaagtttcagtggggaagggattgcaatacctattcataggattattgtgagaatgaaataaagcttgataatttatgtaaagcctctagaataggtgcctggtgtgtaataaccacttaatacttctgacctggggatgcctcccaaaaaggtttttttgttgttcgggttagcatggtggtgaagagtgtggaagagcaactgcttagattcaaatccatgttccaccactttagataacctctctttgacttggtttcctcatctgcaaaatggagatgttatatcaagtatttcagggttgttatgaggactcaataagctaatagtgtggaacattgagaaaagtacctggcacatcataagcacttgataaaattaatatactaataatgatgctgataattatactgccattgttatttcctgacctggaattcttattttttttaatttactgaaggctgggtacagtggctcacacctgtaatctcagcactttgggaggccaaagcaggcagattgcttgagcccagaagttggagaccagtgagggcaacatagtgagactccatctctattaaaaatatatatattgaaaaatttaaaatttgttgaaaaaatgtaactgtacaaaacgtgaaagttgcctctcctctaccccaaatcaccttttttcctcctgcctcctattcttgactaatgttagtgcttcatcatctcatttttctcctaatccctttttccaaatatctcttagcctgaggtcttcataacttccatcatcccgcttcattattacctagttacttttcatttgtcttagcatcctaattccagactcctcattcttctaatttccccaggccaaattcctgcatccctcttcacccctcttcatctctctacctccaaagaggaaacccttggagataagggggttagagacaccagtatcacctccctgctcttcctgcctcctcaaattgttttctcttctacttcccttttcataaattagctgtaatactcctgttagcaacttttaaaaacagtaaaaaattgtctttctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaattagccgggcacggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaaaaattgtctttctcattatataggtatcaaaagtgttcagaaacaaatatacagcctttaagtggaaatagagctatctggtactatttttaaaaaattctaaccatcaagaaacaaaagttcaggattttcttctcttatggaacttttatttgaaaggaaagtatagaaaagttggtctcactttccagtggacaaattcaccatatcgtcctgatctgtaccatatgaatgttaagaatatagattaagttatctttttccttgattaaggacaccagtcaattatatggatttcccaggactggtatatgtctgatagtcactggcatggctgtatctgttgttaaatgtggagagacttctgtattgggtagtccatagctgctaattggagccccaggtaatccctgactgacctggttcattccgctgtacccccttgatctggcaactaaagggttaacagctggaggcttctgggatccagcttgagctggtggttaagtacactgaacatcagccctggacctctgcagtgccacttattgttcctaaaattctagattaaggcaaaccctttttggttgtcaagaacatagtgctgtctccaaggaacagcttagtcggtcccaccagaagcatctgttgggagcaggttgggcaccaacccttgcaggactttgggatttgggacaatgtagatttgtgtgagtgcacattaagtctcattgcaaaatagaaaaaaaaaagttaggaaaaaggagcaagaagttattcttttaaagtagagactgccttactcatcgtagcacctagcacctggcgtaatgctggcatatggtatgcacataattaatataaattgagcgaacgaatgcaggaatgggtgcatgcctcctgcttcaccatcaggatattcttgttgggataatggtaactcacatttatatagcagtttagactttacaatgtggtgctttgcaccttgtaaatttctaatataattccaacatccttggttacttccagttttccgtctcacatgtagtcctacacaaggtttttttccaaaggagaatatgtagttaattggccaagaaattgcaagctgggggaaaaattataaatactgggaaataaaggattcttcatagggaacgaaacagggtttgttaatgatttatgggaattatgtgaagggccacattatgcatcaacaataccctccagcctatatttcaagcacatgcagttttttgccgcagtgcttctgctgcaaagacctacccccacttctcttagcctgtctgtccccactccatacccccgacctttcatccagctggcctgtgcttgctaaagctccctttatcctttcccagctccctttccatgttggagtaggttccccccttccatgctctcatagcaccctgcaaccttattaggctgtaattattacatagttagattgatctccaactagattgtcatctctttggtggagagattacgttcttgtgtatcttcagtgcctgacacagaagtgtttctaaaagtaacatctgcacacccctcaaacagaatcacaaggggcgaggccaagaaatctgctctccaagtgataacttaaactttttaacatgctcttcaggtgacacttaaacttgtttgaaaacctctgtgtcataaaactaaatattagctggatgaatgtatttgtatctttttctgtgttggcctttgtgaggagaaatgctgtctatgcaccaaatcagagctgaaaaattctagtgttttgttaaaaaaaaaaaagagagagagagagctgggtttggtggtgcatgcctgtagtcccagctacttgggaagctaagccaggaggactgcttgagcacaggagttcaagtccagcctgggcaacatggtaagaccccattgctaataaatgaataaatttttctctcaaggtgagagatactagtactaatactactactaataatgagatcactgtatgaattcctttctgtttctacattaatccctttctgtttctgggtgtgcatttttgtgtgtaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctgc

SEQ ID NO: 2 - DNA, 7049 bp, homo sapien
gtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggtgagaggccgcgggcccctggaggaggacaaccccacgatgccggagacggctcccggaggctggcgggatagcgaggagcgcggctgcgctgggccaggcccggctccgcgtacctgtcttcctggtgcggcctgcagggtagccttctcgcccgtccctgccggttcccaggctctgctcggccgtggaaccccccccacccacccacccaccgcccctaccctggctgagccctcctaacccaccacccctctgcggcattcttttgcaagcttacctggcccggcctaggccctccttaccgtcacctcacccttctccgggaagcccctacccaccgccagcccctcacgggggggtcgaccttccctgcccgcagtttcccactctgtcctcaggctgggggctccctggcctcttcatccctcccatcaaatgactcaggtcttcccatcccattagctgctccgggttcaatgtagttctactggatagaaagagcaagggctttgaaatcagataatgaccttggggaagttatctaacctccctgaggttttcctgatcgatagaaatacaatgggaatcacaataatacagaaccttgctctctgtgaggattaggctttgaaaatgctaacctaagacattttggggcgcgcggggaatggggttggaagaattcaggtcgtgagttgatttatgaaagcccctatagcatgttttaatgttcactaaaaatttaaaacagcacactagatatatcagaggctgttcacatatcttaatgaaaaatcattgccactcaaattatacaataaattttcatccatattctttgcttgctagttacttcaggatgtctcatttgtaagaatatgcatgtgaattcattcttactgcagctaatatgcatgcttaagactggtgttccagcttaaaatctttctgattttgtgactttaatcacatcttctataacctattctccgtcccagagatgaagagtagcttgtatgtttgcattgcaaataacatgggtaatctttattgaatatttatgagtagcaaagcagtattaatttattccccttccaaaaccacttttattttctgccgtcatcatgtcattccaaattatggtcacagcctcctttttcttaaagtctcaggagttactactaagacctgagtttactttccctccattttcttgatttctgttatactaaagtttttctgcaaaccttttcgtcttttctgtcctctgctttttctcccttttctcttcccagcccatgattcctttttttctaattatctcaataggagtgatttatgattactttatatgtgaactacagttagatacatagaagaatgtgtgtgtgtgtgtgtgtgtgtgtgtgtgtgtgtgtgtgtctatctgtatctacatagatgtagatatagctatataggtgtatcagaatttcggattccagaaagtttcagtggggaagggattgcaatacctattcataggattattgtgagaatgaaataaagcttgataatttatgtaaagcctctagaataggtgcctggtgtgtaataaccacttaatacttctgacctggggatgcctcccaaaaaggtttttttgttgttcgggttagcatggtggtgaagagtgtggaagagcaactgcttagattcaaatccatgttccaccactttagataacctctctttgacttggtttcctcatctgcaaaatggagatgttatatcaagtatttcagggttgttatgaggactcaataagctaatagtgtggaacattgagaaaagtacctggcacatcataagcacttgataaaattaatatactaataatgatgctgataattatactgccattgttatttcctgacctggaattcttattttttttaatttactgaaggctgggtacagtggctcacacctgtaatctcagcactttgggaggccaaagcaggcagattgcttgagcccagaagttggagaccagtgagggcaacatagtgagactccatctctattaaaaatatatatattgaaaaatttaaaatttgttgaaaaaatgtaactgtacaaaacgtgaaagttgcctctcctctaccccaaatcaccttttttcctcctgcctcctattcttgactaatgttagtgcttcatcatctcatttttctcctaatccctttttccaaatatctcttagcctgaggtcttcataacttccatcatcccgcttcattattacctagttacttttcatttgtcttagcatcctaattccagactcctcattcttctaatttccccaggccaaattcctgcatccctcttcacccctcttcatctctctacctccaaagaggaaacccttggagataagggggttagagacaccagtatcacctccctgctcttcctgcctcctcaaattgttttctcttctacttcccttttcataaattagctgtaatactcctgttagcaacttttaaaaacagtaaaaaattgtctttctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaattagccgggcacggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaaaaattgtctttctcattatataggtatcaaaagtgttcagaaacaaatatacagcctttaagtggaaatagagctatctggtactatttttaaaaaattctaaccatcaagaaacaaaagttcaggattttcttctcttatggaacttttatttgaaaggaaagtatagaaaagttggtctcactttccagtggacaaattcaccatatcgtcctgatctgtaccatatgaatgttaagaatatagattaagttatctttttccttgattaaggacaccagtcaattatatggatttcccaggactggtatatgtctgatagtcactggcatggctgtatctgttgttaaatgtggagagacttctgtattgggtagtccatagctgctaattggagccccaggtaatccctgactgacctggttcattccgctgtacccccttgatctggcaactaaagggttaacagctggaggcttctgggatccagcttgagctggtggttaagtacactgaacatcagccctggacctctgcagtgccacttattgttcctaaaattctagattaaggcaaaccctttttggttgtcaagaacatagtgctgtctccaaggaacagcttagtcggtcccaccagaagcatctgttgggagcaggttgggcaccaacccttgcaggactttgggatttgggacaatgtagatttgtgtgagtgcacattaagtctcattgcaaaatagaaaaaaaaaagttaggaaaaaggagcaagaagttattcttttaaagtagagactgccttactcatcgtagcacctagcacctggcgtaatgctggcatatggtatgcacataattaatataaattgagcgaacgaatgcaggaatgggtgcatgcctcctgcttcaccatcaggatattcttgttgggataatggtaactcacatttatatagcagtttagactttacaatgtggtgctttgcaccttgtaaatttctaatataattccaacatccttggttacttccagttttccgtctcacatgtagtcctacacaaggtttttttccaaaggagaatatgtagttaattggccaagaaattgcaagctgggggaaaaattataaatactgggaaataaaggattcttcatagggaacgaaacagggtttgttaatgatttatgggaattatgtgaagggccacattatgcatcaacaataccctccagcctatatttcaagcacatgcagttttttgccgcagtgcttctgctgcaaagacctacccccacttctcttagcctgtctgtccccactccatacccccgacctttcatccagctggcctgtgcttgctaaagctccctttatcctttcccagctccctttccatgttggagtaggttccccccttccatgctctcatagcaccctgcaaccttattaggctgtaattattacatagttagattgatctccaactagattgtcatctctttggtggagagattacgttcttgtgtatcttcagtgcctgacacagaagtgtttctaaaagtaacatctgcacacccctcaaacagaatcacaaggggcgaggccaagaaatctgctctccaagtgataacttaaactttttaacatgctcttcaggtgacacttaaacttgtttgaaaacctctgtgtcataaaactaaatattagctggatgaatgtatttgtatctttttctgtgttggcctttgtgaggagaaatgctgtctatgcaccaaatcagagctgaaaaattctagtgttttgttaaaaaaaaaaaagagagagagagagctgggtttggtggtgcatgcctgtagtcccagctacttgggaagctaagccaggaggactgcttgagcacaggagttcaagtccagcctgggcaacatggtaagaccccattgctaataaatgaataaatttttctctcaaggtgagagatactagtactaatactactactaataatgagatcactgtatgaattcctttctgtttctacattaatccctttctgtttctgggtgtgcatttttgtgtgtaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctgc

SEQ ID NO: 3 - DNA, 7056 bp, homo sapien
gtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggtgagaggccgcgggcccctggaggaggacaaccccacgatgccggagacggctcccggaggctggcgggatagcgaggagcgcggctgcgctgggccaggcccggctccgcgtacctgtcttcctggtgcggcctgcagggtagccttctcgcccgtccctgccggttcccaggctctgctcggccgtggaaccccccccacccacccacccaccgcccctaccctggctgagccctcctaacccaccacccctctgcggcattcttttgcaagcttacctggcccggcctaggccctccttaccgtcacctcacccttctccgggaagcccctacccaccgccagcccctcacgggggggtcgaccttccctgcccgcagtttcccactctgtcctcaggctgggggctccctggcctcttcatccctcccatcaaatgactcaggtcttcccatcccattagctgctccgggttcaatgtagttctactggatagaaagagcaagggctttgaaatcagataatgaccttggggaagttatctaacctccctgaggttttcctgatcgatagaaatacaatgggaatcacaataatacagaaccttgctctctgtgaggattaggctttgaaaatgctaacctaagacattttggggcgcgcggggaatggggttggaagaattcaggtcgtgagttgatttatgaaagcccctatagcatgttttaatgttcactaaaaatttaaaacagcacactagatatatcagaggctgttcacatatcttaatgaaaaatcattgccactcaaattatacaataaattttcatccatattctttgcttgctagttacttcaggatgtctcatttgtaagaatatgcatgtgaattcattcttactgcagctaatatgcatgcttaagactggtgttccagcttaaaatctttctgattttgtgactttaatcacatcttctataacctattctccgtcccagagatgaagagtagcttgtatgtttgcattgcaaataacatgggtaatctttattgaatatttatgagtagcaaagcagtattaatttattccccttccaaaaccacttttattttctgccgtcatcatgtcattccaaattatggtcacagcctcctttttcttaaagtctcaggagttactactaagacctgagtttactttccctccattttcttgatttctgttatactaaagtttttctgcaaaccttttcgtcttttctgtcctctgctttttctcccttttctcttcccagcccatgattcctttttttctaattatctcaataggagtgatttatgattactttatatgtgaactacagttagatacatagaagaatgtgtgtgtgtgtgtgtgtgtgtgtgtgtgtgtgtgtgtgtctatctgtatctacatagatgtagatatagctatataggtgtatcagaatttcggattccagaaagtttcagtggggaagggattgcaatacctattcataggattattgtgagaatgaaataaagcttgataatttatgtaaagcctctagaataggtgcctggtgtgtaataaccacttaatacttctgacctggggatgcctcccaaaaaggtttttttgttgttcgggttagcatggtggtgaagagtgtggaagagcaactgcttagattcaaatccatgttccaccactttagataacctctctttgacttggtttcctcatctgcaaaatggagatgttatatcaagtatttcagggttgttatgaggactcaataagctaatagtgtggaacattgagaaaagtacctggcacatcataagcacttgataaaattaatatactaataatgatgctgataattatactgccattgttatttcctgacctggaattcttattttttttaatttactgaaggctgggtacagtggctcacacctgtaatctcagcactttgggaggccaaagcaggcagattgcttgagcccagaagttggagaccagtgagggcaacatagtgagactccatctctattaaaaatatatatattgaaaaatttaaaatttgttgaaaaaatgtaactgtacaaaacgtgaaagttgcctctcctctaccccaaatcaccttttttcctcctgcctcctattcttgactaatgttagtgcttcatcatctcatttttctcctaatccctttttccaaatatctcttagcctgaggtcttcataacttccatcatcccgcttcattattacctagttacttttcatttgtcttagcatcctaattccagactcctcattcttctaatttccccaggccaaattcctgcatccctcttcacccctcttcatctctctacctccaaagaggaaacccttggagataagggggttagagacaccagtatcacctccctgctcttcctgcctcctcaaattgttttctcttctacttcccttttcataaattagctgtaatactcctgttagcaacttttaaaaacagtaaaaaattgtctttctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaattagccgggcacggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaaaaattgtctttctcattatataggtatcaaaagtgttcagaaacaaatatacagcctttaagtggaaatagagctatctggtactatttttaaaaaattctaaccatcaagaaacaaaagttcaggattttcttctcttatggaacttttatttgaaaggaaagtatagaaaagttggtctcactttccagtggacaaattcaccatatcgtcctgatctgtaccatatgaatgttaagaatatagattaagttatctttttccttgattaaggacaccagtcaattatatggatttcccaggactggtatatgtctgatagtcactggcatggctgtatctgttgttaaatgtggagagacttctgtattgggtagtccatagctgctaattggagccccaggtaatccctgactgacctggttcattccgctgtacccccttgatctggcaactaaagggttaacagctggaggcttctgggatccagcttgagctggtggttaagtacactgaacatcagccctggacctctgcagtgccacttattgttcctaaaattctagattaaggcaaaccctttttggttgtcaagaacatagtgctgtctccaaggaacagcttagtcggtcccaccagaagcatctgttgggagcaggttgggcaccaacccttgcaggactttgggatttgggacaatgtagatttgtgtgagtgcacattaagtctcattgcaaaatagaaaaaaaaaagttaggaaaaaggagcaagaagttattcttttaaagtagagactgccttactcatcgtagcacctagcacctggcgtaatgctggcatatggtatgcacataattaatataaattgagcgaacgaatgcaggaatgggtgcatgcctcctgcttcaccatcaggatattcttgttgggataatggtaactcacatttatatagcagtttagactttacaatgtggtgctttgcaccttgtaaatttctaatataattccaacatccttggttacttccagttttccgtctcacatgtagtcctacacaaggtttttttccaaaggagaatatgtagttaattggccaagaaattgcaagctgggggaaaaattataaatactgggaaataaaggattcttcatagggaacgaaacagggtttgttaatgatttatgggaattatgtgaagggccacattatgcatcaacaataccctccagcctatatttcaagcacatgcagttttttgccgcagtgcttctgctgcaaagacctacccccacttctcttagcctgtctgtccccactccatacccccgacctttcatccagctggcctgtgcttgctaaagctccctttatcctttcccagctccctttccatgttggagtaggttccccccttccatgctctcatagcaccctgcaaccttattaggctgtaattattacatagttagattgatctccaactagattgtcatctctttggtggagagattacgttcttgtgtatcttcagtgcctgacacagaagtgtttctaaaagtaacatctgcacacccctcaaacagaatcacaaggggcgaggccaagaaatctgctctccaagtgataacttaaactttttaacatgctcttcaggtgacacttaaacttgtttgaaaacctctgtgtcataaaactaaatattagctggatgaatgtatttgtatctttttctgtgttggcctttgtgaggagaaatgctgtctatgcaccaaatcagagctgaaaaattctagtgttttgttaaaaaaaaaaaagagagagagagagctgggtttggtggtgcatgcctgtagtcccagctacttgggaagctaagccaggaggactgcttgagcacaggagttcaagtccagcctgggcaacatggtaagaccccattgctaataaatgaataaatttttctctcaaggtgagagatactagtactaatactactactaataatgagatcactgtatgaattcctttctgtttctacattaatccctttctgtttctgggtgtgcatttttgtgtgtaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatactttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctgc

SEQ ID NO: 4 - DNA, 7056 bp, homo sapien
gtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggtgagaggccgcgggcccctggaggaggacaaccccacgatgccggagacggctcccggaggctggcgggatagcgaggagcgcggctgcgctgggccaggcccggctccgcgtacctgtcttcctggtgcggcctgcagggtagccttctcgcccgtccctgccggttcccaggctctgctcggccgtggaaccccccccacccacccacccaccgcccctaccctggctgagccctcctaacccaccacccctctgcggcattcttttgcaagcttacctggcccggcctaggccctccttaccgtcacctcacccttctccgggaagcccctacccaccgccagcccctcacgggggggtcgaccttccctgcccgcagtttcccactctgtcctcaggctgggggctccctggcctcttcatccctcccatcaaatgactcaggtcttcccatcccattagctgctccgggttcaatgtagttctactggatagaaagagcaagggctttgaaatcagataatgaccttggggaagttatctaacctccctgaggttttcctgatcgatagaaatacaatgggaatcacaataatacagaaccttgctctctgtgaggattaggctttgaaaatgctaacctaagacattttggggcgcgcggggaatggggttggaagaattcaggtcgtgagttgatttatgaaagcccctatagcatgttttaatgttcactaaaaatttaaaacagcacactagatatatcagaggctgttcacatatcttaatgaaaaatcattgccactcaaattatacaataaattttcatccatattctttgcttgctagttacttcaggatgtctcatttgtaagaatatgcatgtgaattcattcttactgcagctaatatgcatgcttaagactggtgttccagcttaaaatctttctgattttgtgactttaatcacatcttctataacctattctccgtcccagagatgaagagtagcttgtatgtttgcattgcaaataacatgggtaatctttattgaatatttatgagtagcaaagcagtattaatttattccccttccaaaaccacttttattttctgccgtcatcatgtcattccaaattatggtcacagcctcctttttcttaaagtctcaggagttactactaagacctgagtttactttccctccattttcttgatttctgttatactaaagtttttctgcaaaccttttcgtcttttctgtcctctgctttttctcccttttctcttcccagcccatgattcctttttttctaattatctcaataggagtgatttatgattactttatatgtgaactacagttagatacatagaagaatgtgtgtgtgtgtgtgtgtgtgtgtgtgtgtgtgtgtgtgtctatctgtatctacatagatgtagatatagctatataggtgtatcagaatttcggattccagaaagtttcagtggggaagggattgcaatacctattcataggattattgtgagaatgaaataaagcttgataatttatgtaaagcctctagaataggtgcctggtgtgtaataaccacttaatacttctgacctggggatgcctcccaaaaaggtttttttgttgttcgggttagcatggtggtgaagagtgtggaagagcaactgcttagattcaaatccatgttccaccactttagataacctctctttgacttggtttcctcatctgcaaaatggagatgttatatcaagtatttcagggttgttatgaggactcaataagctaatagtgtggaacattgagaaaagtacctggcacatcataagcacttgataaaattaatatactaataatgatgctgataattatactgccattgttatttcctgacctggaattcttattttttttaatttactgaaggctgggtacagtggctcacacctgtaatctcagcactttgggaggccaaagcaggcagattgcttgagcccagaagttggagaccagtgagggcaacatagtgagactccatctctattaaaaatatatatattgaaaaatttaaaatttgttgaaaaaatgtaactgtacaaaacgtgaaagttgcctctcctctaccccaaatcaccttttttcctcctgcctcctattcttgactaatgttagtgcttcatcatctcatttttctcctaatccctttttccaaatatctcttagcctgaggtcttcataacttccatcatcccgcttcattattacctagttacttttcatttgtcttagcatcctaattccagactcctcattcttctaatttccccaggccaaattcctgcatccctcttcacccctcttcatctctctacctccaaagaggaaacccttggagataagggggttagagacaccagtatcacctccctgctcttcctgcctcctcaaattgttttctcttctacttcccttttcataaattagctgtaatactcctgttagcaacttttaaaaacagtaaaaaattgtctttctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaattagccgggcacggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaaaaattgtctttctcattatataggtatcaaaagtgttcagaaacaaatatacagcctttaagtggaaatagagctatctggtactatttttaaaaaattctaaccatcaagaaacaaaagttcaggattttcttctcttatggaacttttatttgaaaggaaagtatagaaaagttggtctcactttccagtggacaaattcaccatatcgtcctgatctgtaccatatgaatgttaagaatatagattaagttatctttttccttgattaaggacaccagtcaattatatggatttcccaggactggtatatgtctgatagtcactggcatggctgtatctgttgttaaatgtggagagacttctgtattgggtagtccatagctgctaattggagccccaggtaatccctgactgacctggttcattccgctgtacccccttgatctggcaactaaagggttaacagctggaggcttctgggatccagcttgagctggtggttaagtacactgaacatcagccctggacctctgcagtgccacttattgttcctaaaattctagattaaggcaaaccctttttggttgtcaagaacatagtgctgtctccaaggaacagcttagtcggtcccaccagaagcatctgttgggagcaggttgggcaccaacccttgcaggactttgggatttgggacaatgtagatttgtgtgagtgcacattaagtctcattgcaaaatagaaaaaaaaaagttaggaaaaaggagcaagaagttattcttttaaagtagagactgccttactcatcgtagcacctagcacctggcgtaatgctggcatatggtatgcacataattaatataaattgagcgaacgaatgcaggaatgggtgcatgcctcctgcttcaccatcaggatattcttgttgggataatggtaactcacatttatatagcagtttagactttacaatgtggtgctttgcaccttgtaaatttctaatataattccaacatccttggttacttccagttttccgtctcacatgtagtcctacacaaggtttttttccaaaggagaatatgtagttaattggccaagaaattgcaagctgggggaaaaattataaatactgggaaataaaggattcttcatagggaacgaaacagggtttgttaatgatttatgggaattatgtgaagggccacattatgcatcaacaataccctccagcctatatttcaagcacatgcagttttttgccgcagtgcttctgctgcaaagacctacccccacttctcttagcctgtctgtccccactccatacccccgacctttcatccagctggcctgtgcttgctaaagctccctttatcctttcccagctccctttccatgttggagtaggttccccccttccatgctctcatagcaccctgcaaccttattaggctgtaattattacatagttagattgatctccaactagattgtcatctctttggtggagagattacgttcttgtgtatcttcagtgcctgacacagaagtgtttctaaaagtaacatctgcacacccctcaaacagaatcacaaggggcgaggccaagaaatctgctctccaagtgataacttaaactttttaacatgctcttcaggtgacacttaaacttgtttgaaaacctctgtgtcataaaactaaatattagctggatgaatgtatttgtatctttttctgtgttggcctttgtgaggagaaatgctgtctatgcaccaaatcagagctgaaaaattctagtgttttgttaaaaaaaaaaaagagagagagagagctgggtttggtggtgcatgcctgtagtcccagctacttgggaagctaagccaggaggactgcttgagcacaggagttcaagtccagcctgggcaacatggtaagaccccattgctaataaatgaataaatttttctctcaaggtgagagatactagtactaatactactactaataatgagatcactgtatgaattcctttctgtttctacattaatccctttctgtttctgggtgtgcatttttgtgtgtaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgcttaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctgc

SEQ ID NO: 5 - DNA, 7052 bp, homo sapien
gtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggtgagaggccgcgggcccctggaggaggacaaccccacgatgccggagacggctcccggaggctggcgggatagcgaggagcgcggctgcgctgggccaggcccggctccgcgtacctgtcttcctggtgcggcctgcagggtagccttctcgcccgtccctgccggttcccaggctctgctcggccgtggaaccccccccacccacccacccaccgcccctaccctggctgagccctcctaacccaccacccctctgcggcattcttttgcaagcttacctggcccggcctaggccctccttaccgtcacctcacccttctccgggaagcccctacccaccgccagcccctcacgggggggtcgaccttccctgcccgcagtttcccactctgtcctcaggctgggggctccctggcctcttcatccctcccatcaaatgactcaggtcttcccatcccattagctgctccgggttcaatgtagttctactggatagaaagagcaagggctttgaaatcagataatgaccttggggaagttatctaacctccctgaggttttcctgatcgatagaaatacaatgggaatcacaataatacagaaccttgctctctgtgaggattaggctttgaaaatgctaacctaagacattttggggcgcgcggggaatggggttggaagaattcaggtcgtgagttgatttatgaaagcccctatagcatgttttaatgttcactaaaaatttaaaacagcacactagatatatcagaggctgttcacatatcttaatgaaaaatcattgccactcaaattatacaataaattttcatccatattctttgcttgctagttacttcaggatgtctcatttgtaagaatatgcatgtgaattcattcttactgcagctaatatgcatgcttaagactggtgttccagcttaaaatctttctgattttgtgactttaatcacatcttctataacctattctccgtcccagagatgaagagtagcttgtatgtttgcattgcaaataacatgggtaatctttattgaatatttatgagtagcaaagcagtattaatttattccccttccaaaaccacttttattttctgccgtcatcatgtcattccaaattatggtcacagcctcctttttcttaaagtctcaggagttactactaagacctgagtttactttccctccattttcttgatttctgttatactaaagtttttctgcaaaccttttcgtcttttctgtcctctgctttttctcccttttctcttcccagcccatgattcctttttttctaattatctcaataggagtgatttatgattactttatatgtgaactacagttagatacatagaagaatgtgtgtgtgtgtgtgtgtgtgtgtgtgtgtgtgtgtgtgtctatctgtatctacatagatgtagatatagctatataggtgtatcagaatttcggattccagaaagtttcagtggggaagggattgcaatacctattcataggattattgtgagaatgaaataaagcttgataatttatgtaaagcctctagaataggtgcctggtgtgtaataaccacttaatacttctgacctggggatgcctcccaaaaaggtttttttgttgttcgggttagcatggtggtgaagagtgtggaagagcaactgcttagattcaaatccatgttccaccactttagataacctctctttgacttggtttcctcatctgcaaaatggagatgttatatcaagtatttcagggttgttatgaggactcaataagctaatagtgtggaacattgagaaaagtacctggcacatcataagcacttgataaaattaatatactaataatgatgctgataattatactgccattgttatttcctgacctggaattcttattttttttaatttactgaaggctgggtacagtggctcacacctgtaatctcagcactttgggaggccaaagcaggcagattgcttgagcccagaagttggagaccagtgagggcaacatagtgagactccatctctattaaaaatatatatattgaaaaatttaaaatttgttgaaaaaatgtaactgtacaaaacgtgaaagttgcctctcctctaccccaaatcaccttttttcctcctgcctcctattcttgactaatgttagtgcttcatcatctcatttttctcctaatccctttttccaaatatctcttagcctgaggtcttcataacttccatcatcccgcttcattattacctagttacttttcatttgtcttagcatcctaattccagactcctcattcttctaatttccccaggccaaattcctgcatccctcttcacccctcttcatctctctacctccaaagaggaaacccttggagataagggggttagagacaccagtatcacctccctgctcttcctgcctcctcaaattgttttctcttctacttcccttttcataaattagctgtaatactcctgttagcaacttttaaaaacagtaaaaaattgtctttctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaattagccgggcacggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaaaaattgtctttctcattatataggtatcaaaagtgttcagaaacaaatatacagcctttaagtggaaatagagctatctggtactatttttaaaaaattctaaccatcaagaaacaaaagttcaggattttcttctcttatggaacttttatttgaaaggaaagtatagaaaagttggtctcactttccagtggacaaattcaccatatcgtcctgatctgtaccatatgaatgttaagaatatagattaagttatctttttccttgattaaggacaccagtcaattatatggatttcccaggactggtatatgtctgatagtcactggcatggctgtatctgttgttaaatgtggagagacttctgtattgggtagtccatagctgctaattggagccccaggtaatccctgactgacctggttcattccgctgtacccccttgatctggcaactaaagggttaacagctggaggcttctgggatccagcttgagctggtggttaagtacactgaacatcagccctggacctctgcagtgccacttattgttcctaaaattctagattaaggcaaaccctttttggttgtcaagaacatagtgctgtctccaaggaacagcttagtcggtcccaccagaagcatctgttgggagcaggttgggcaccaacccttgcaggactttgggatttgggacaatgtagatttgtgtgagtgcacattaagtctcattgcaaaatagaaaaaaaaaagttaggaaaaaggagcaagaagttattcttttaaagtagagactgccttactcatcgtagcacctagcacctggcgtaatgctggcatatggtatgcacataattaatataaattgagcgaacgaatgcaggaatgggtgcatgcctcctgcttcaccatcaggatattcttgttgggataatggtaactcacatttatatagcagtttagactttacaatgtggtgctttgcaccttgtaaatttctaatataattccaacatccttggttacttccagttttccgtctcacatgtagtcctacacaaggtttttttccaaaggagaatatgtagttaattggccaagaaattgcaagctgggggaaaaattataaatactgggaaataaaggattcttcatagggaacgaaacagggtttgttaatgatttatgggaattatgtgaagggccacattatgcatcaacaataccctccagcctatatttcaagcacatgcagttttttgccgcagtgcttctgctgcaaagacctacccccacttctcttagcctgtctgtccccactccatacccccgacctttcatccagctggcctgtgcttgctaaagctccctttatcctttcccagctccctttccatgttggagtaggttccccccttccatgctctcatagcaccctgcaaccttattaggctgtaattattacatagttagattgatctccaactagattgtcatctctttggtggagagattacgttcttgtgtatcttcagtgcctgacacagaagtgtttctaaaagtaacatctgcacacccctcaaacagaatcacaaggggcgaggccaagaaatctgctctccaagtgataacttaaactttttaacatgctcttcaggtgacacttaaacttgtttgaaaacctctgtgtcataaaactaaatattagctggatgaatgtatttgtatctttttctgtgttggcctttgtgaggagaaatgctgtctatgcaccaaatcagagctgaaaaattctagtgttttgttaaaaaaaaaaaagagagagagagagctgggtttggtggtgcatgcctgtagtcccagctacttgggaagctaagccaggaggactgcttgagcacaggagttcaagtccagcctgggcaacatggtaagaccccattgctaataaatgaataaatttttctctcaaggtgagagatactagtactaatactactactaataatgagatcactgtatgaattcctttctgtttctacattaatccctttctgtttctgggtgtgcatttttgtgtgtaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctgc

SEQ ID NO: 6 - DNA, 7057 bp, homo sapien
gtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggtgagaggccgcgggcccctggaggaggacaaccccacgatgccggagacggctcccggaggctggcgggatagcgaggagcgcggctgcgctgggccaggcccggctccgcgtacctgtcttcctggtgcggcctgcagggtagccttctcgcccgtccctgccggttcccaggctctgctcggccgtggaaccccccccacccacccacccaccgcccctaccctggctgagccctcctaacccaccacccctctgcggcattcttttgcaagcttacctggcccggcctaggccctccttaccgtcacctcacccttctccgggaagcccctacccaccgccagcccctcacgggggggtcgaccttccctgcccgcagtttcccactctgtcctcaggctgggggctccctggcctcttcatccctcccatcaaatgactcaggtcttcccatcccattagctgctccgggttcaatgtagttctactggatagaaagagcaagggctttgaaatcagataatgaccttggggaagttatctaacctccctgaggttttcctgatcgatagaaatacaatgggaatcacaataatacagaaccttgctctctgtgaggattaggctttgaaaatgctaacctaagacattttggggcgcgcggggaatggggttggaagaattcaggtcgtgagttgatttatgaaagcccctatagcatgttttaatgttcactaaaaatttaaaacagcacactagatatatcagaggctgttcacatatcttaatgaaaaatcattgccactcaaattatacaataaattttcatccatattctttgcttgctagttacttcaggatgtctcatttgtaagaatatgcatgtgaattcattcttactgcagctaatatgcatgcttaagactggtgttccagcttaaaatctttctgattttgtgactttaatcacatcttctataacctattctccgtcccagagatgaagagtagcttgtatgtttgcattgcaaataacatgggtaatctttattgaatatttatgagtagcaaagcagtattaatttattccccttccaaaaccacttttattttctgccgtcatcatgtcattccaaattatggtcacagcctcctttttcttaaagtctcaggagttactactaagacctgagtttactttccctccattttcttgatttctgttatactaaagtttttctgcaaaccttttcgtcttttctgtcctctgctttttctcccttttctcttcccagcccatgattcctttttttctaattatctcaataggagtgatttatgattactttatatgtgaactacagttagatacatagaagaatgtgtgtgtgtgtgtgtgtgtgtgtgtgtgtgtgtgtgtgtctatctgtatctacatagatgtagatatagctatataggtgtatcagaatttcggattccagaaagtttcagtggggaagggattgcaatacctattcataggattattgtgagaatgaaataaagcttgataatttatgtaaagcctctagaataggtgcctggtgtgtaataaccacttaatacttctgacctggggatgcctcccaaaaaggtttttttgttgttcgggttagcatggtggtgaagagtgtggaagagcaactgcttagattcaaatccatgttccaccactttagataacctctctttgacttggtttcctcatctgcaaaatggagatgttatatcaagtatttcagggttgttatgaggactcaataagctaatagtgtggaacattgagaaaagtacctggcacatcataagcacttgataaaattaatatactaataatgatgctgataattatactgccattgttatttcctgacctggaattcttattttttttaatttactgaaggctgggtacagtggctcacacctgtaatctcagcactttgggaggccaaagcaggcagattgcttgagcccagaagttggagaccagtgagggcaacatagtgagactccatctctattaaaaatatatatattgaaaaatttaaaatttgttgaaaaaatgtaactgtacaaaacgtgaaagttgcctctcctctaccccaaatcaccttttttcctcctgcctcctattcttgactaatgttagtgcttcatcatctcatttttctcctaatccctttttccaaatatctcttagcctgaggtcttcataacttccatcatcccgcttcattattacctagttacttttcatttgtcttagcatcctaattccagactcctcattcttctaatttccccaggccaaattcctgcatccctcttcacccctcttcatctctctacctccaaagaggaaacccttggagataagggggttagagacaccagtatcacctccctgctcttcctgcctcctcaaattgttttctcttctacttcccttttcataaattagctgtaatactcctgttagcaacttttaaaaacagtaaaaaattgtctttctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaattagccgggcacggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaaaaattgtctttctcattatataggtatcaaaagtgttcagaaacaaatatacagcctttaagtggaaatagagctatctggtactatttttaaaaaattctaaccatcaagaaacaaaagttcaggattttcttctcttatggaacttttatttgaaaggaaagtatagaaaagttggtctcactttccagtggacaaattcaccatatcgtcctgatctgtaccatatgaatgttaagaatatagattaagttatctttttccttgattaaggacaccagtcaattatatggatttcccaggactggtatatgtctgatagtcactggcatggctgtatctgttgttaaatgtggagagacttctgtattgggtagtccatagctgctaattggagccccaggtaatccctgactgacctggttcattccgctgtacccccttgatctggcaactaaagggttaacagctggaggcttctgggatccagcttgagctggtggttaagtacactgaacatcagccctggacctctgcagtgccacttattgttcctaaaattctagattaaggcaaaccctttttggttgtcaagaacatagtgctgtctccaaggaacagcttagtcggtcccaccagaagcatctgttgggagcaggttgggcaccaacccttgcaggactttgggatttgggacaatgtagatttgtgtgagtgcacattaagtctcattgcaaaatagaaaaaaaaaagttaggaaaaaggagcaagaagttattcttttaaagtagagactgccttactcatcgtagcacctagcacctggcgtaatgctggcatatggtatgcacataattaatataaattgagcgaacgaatgcaggaatgggtgcatgcctcctgcttcaccatcaggatattcttgttgggataatggtaactcacatttatatagcagtttagactttacaatgtggtgctttgcaccttgtaaatttctaatataattccaacatccttggttacttccagttttccgtctcacatgtagtcctacacaaggtttttttccaaaggagaatatgtagttaattggccaagaaattgcaagctgggggaaaaattataaatactgggaaataaaggattcttcatagggaacgaaacagggtttgttaatgatttatgggaattatgtgaagggccacattatgcatcaacaataccctccagcctatatttcaagcacatgcagttttttgccgcagtgcttctgctgcaaagacctacccccacttctcttagcctgtctgtccccactccatacccccgacctttcatccagctggcctgtgcttgctaaagctccctttatcctttcccagctccctttccatgttggagtaggttccccccttccatgctctcatagcaccctgcaaccttattaggctgtaattattacatagttagattgatctccaactagattgtcatctctttggtggagagattacgttcttgtgtatcttcagtgcctgacacagaagtgtttctaaaagtaacatctgcacacccctcaaacagaatcacaaggggcgaggccaagaaatctgctctccaagtgataacttaaactttttaacatgctcttcaggtgacacttaaacttgtttgaaaacctctgtgtcataaaactaaatattagctggatgaatgtatttgtatctttttctgtgttggcctttgtgaggagaaatgctgtctatgcaccaaatcagagctgaaaaattctagtgttttgttaaaaaaaaaaaagagagagagagagctgggtttggtggtgcatgcctgtagtcccagctacttgggaagctaagccaggaggactgcttgagcacaggagttcaagtccagcctgggcaacatggtaagaccccattgctaataaatgaataaatttttctctcaaggtgagagatactagtactaatactactactaataatgagatcactgtatgaattcctttctgtttctacattaatccctttctgtttctgggtgtgcatttttgtgtgtaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgtctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctgc

SEQ ID NO: 7 - RNA, 2054 nt, homo sapien
gcgauggcgaugaugccucuaguccugcaucauccagagcggcaggcgagcugggguccggacugcgagauggaggaggggcgcgcugcggcacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagaucaguggcggaucaaaaccuacaagauucaacugaaaaguuggcaguuaugguuuucuuucaucugaugugucaguaucuguugauuugcuuuguaguuuguugacaucuuaagauuugaugugaaaguuuuagauuuuuuacccug

SEQ ID NO: 8 - RNA, 1913 nt, homo sapien
caggcuuacugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucaccccugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacgacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaaugggcuuuauucuaacuugagaucaguggcggaucaaaaccuacaagauucaacugaaaaguuggcaguuaugguuuucuuucaucugaugugucaguaucuguugauuugcuuuguaguuuguuga

SEQ ID NO: 9 - RNA, 1741 nt, homo sapien
ggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagauaguggcggauc

SEQ ID NO: 10 - RNA, 1894 nt, homo sapien
gugacugcgccucugcgcccgcgucuugccgcggcucccgggaugcgcggaggcgguggcgauggcgaugaugccucuaguccugcaucauccagagcggcaggcggagcugggguccggacugcgagauggaggaggggcggcgcugcggccacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaa

SEQ ID NO: 11 - RNA, 2047 nt, homo sapien
gcgauggcgaugaugccucuaguccugcaucauccagagcggcaggcgagcugggguccggacugcgagauggaggaggggcgcgcugcggcacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagaucaguggcggaucaaaaccuacaagauucaacugaaaaguuggcaguuaugguuuucuuucaucugaugugucaguaucuguugauuugcuuuguaguuuguugacaucuuaagauuugaugugaaaguuuuagauuuuuuacccug

SEQ ID NO: 12 - RNA, 2054 nt, homo sapien
gcgauggcgaugaugccucuaguccugcaucauccagagcggcaggcgagcugggguccggacugcgagauggaggaggggcgcgcugcggcacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggauacuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagaucaguggcggaucaaaaccuacaagauucaacugaaaaguuggcaguuaugguuuucuuucaucugaugugucaguaucuguugauuugcuuuguaguuuguugacaucuuaagauuugaugugaaaguuuuagauuuuuuacccug

SEQ ID NO: 13 - RNA, 2054 nt, homo sapien
gcgauggcgaugaugccucuaguccugcaucauccagagcggcaggcgagcugggguccggacugcgagauggaggaggggcgcgcugcggcacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcuuaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagaucaguggcggaucaaaaccuacaagauucaacugaaaaguuggcaguuaugguuuucuuucaucugaugugucaguaucuguugauuugcuuuguaguuuguugacaucuuaagauuugaugugaaaguuuuagauuuuuuacccug

SEQ ID NO: 14 - RNA, 2050 nt, homo sapien
gcgauggcgaugaugccucuaguccugcaucauccagagcggcaggcgagcugggguccggacugcgagauggaggaggggcgcgcugcggcacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagaucaguggcggaucaaaaccuacaagauucaacugaaaaguuggcaguuaugguuuucuuucaucugaugugucaguaucuguugauuugcuuuguaguuuguugacaucuuaagauuugaugugaaaguuuuagauuuuuuacccug

SEQ ID NO: 15 - RNA, 2055 nt, homo sapien
gcgauggcgaugaugccucuaguccugcaucauccagagcggcaggcgagcugggguccggacugcgagauggaggaggggcgcgcugcggcacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugucugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagaucaguggcggaucaaaaccuacaagauucaacugaaaaguuggcaguuaugguuuucuuucaucugaugugucaguaucuguugauuugcuuuguaguuuguugacaucuuaagauuugaugugaaaguuuuagauuuuuuacccug

SEQ ID NO: 16 - RNA, 1906 nt, homo sapien
caggcuuacugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucaccccugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacgacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaaugggcuuuauucuaacuugagaucaguggcggaucaaaaccuacaagauucaacugaaaaguuggcaguuaugguuuucuuucaucugaugugucaguaucuguugauuugcuuuguaguuuguuga

SEQ ID NO: 17 - RNA, 1913 nt, homo sapien
caggcuuacugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggauacuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucaccccugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacgacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaaugggcuuuauucuaacuugagaucaguggcggaucaaaaccuacaagauucaacugaaaaguuggcaguuaugguuuucuuucaucugaugugucaguaucuguugauuugcuuuguaguuuguuga

SEQ ID NO: 18 - RNA, 1913 nt, homo sapien
caggcuuacugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucaccccugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcuuaagucagaaagugccccccuguaaucacagucgaugcuuccagaccacagccuuucaugggggucccugugcagggagguggagaucccauccagugugccaugccggcucuguauaggaaccagaauuacgacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaaugggcuuuauucuaacuugagaucaguggcggaucaaaaccuacaagauucaacugaaaaguuggcaguuaugguuuucuuucaucugaugugucaguaucuguugauuugcuuuguaguuuguuga

SEQ ID NO: 19 - RNA, 1909 nt, homo sapien
caggcuuacugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucaccccugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagugccccccuguaaucacagucgaugcuuccagaccacagccuuucaugggggucccugugcagggagguggagaucccauccagugugccaugccggcucuguauaggaaccagaauuacgacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaaugggcuuuauucuaacuugagaucaguggcggaucaaaaccuacaagauucaacugaaaaguuggcaguuaugguuuucuuucaucugaugugucaguaucuguugauuugcuuuguaguuuguuga

SEQ ID NO: 20 - RNA, 1914 nt, homo sapien
caggcuuacugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucaccccugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacgacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugucugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaaugggcuuuauucuaacuugagaucaguggcggaucaaaaccuacaagauucaacugaaaaguuggcaguuaugguuuucuuucaucugaugugucaguaucuguugauuugcuuuguaguuuguuga

SEQ ID NO: 21 - RNA, 1734 nt, homo sapien
ggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagauaguggcggauc

SEQ ID NO: 22 - RNA, 1741 nt, homo sapien
ggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggauacuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagauaguggcggauc

SEQ ID NO: 23 - RNA, 1741 nt, homo sapien
ggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcuuaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagauaguggcggauc

SEQ ID NO: 24 - RNA, 1737 nt, homo sapien
ggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagauaguggcggauc

SEQ ID NO: 25 - RNA, 1742 nt, homo sapien
ggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugucugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagauaguggcggauc

SEQ ID NO: 26 - RNA, 1887 nt, homo sapien
gugacugcgccucugcgcccgcgucuugccgcggcucccgggaugcgcggaggcgguggcgauggcgaugaugccucuaguccugcaucauccagagcggcaggcggagcugggguccggacugcgagauggaggaggggcggcgcugcggccacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaa

SEQ ID NO: 27 - RNA, 1894 nt, homo sapien
gugacugcgccucugcgcccgcgucuugccgcggcucccgggaugcgcggaggcgguggcgauggcgaugaugccucuaguccugcaucauccagagcggcaggcggagcugggguccggacugcgagauggaggaggggcggcgcugcggccacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggauacuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaa

SEQ ID NO: 28 - RNA, 1894 nt, homo sapien
gugacugcgccucugcgcccgcgucuugccgcggcucccgggaugcgcggaggcgguggcgauggcgaugaugccucuaguccugcaucauccagagcggcaggcggagcugggguccggacugcgagauggaggaggggcggcgcugcggccacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcuuaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaa

SEQ ID NO: 29 - RNA, 1890 nt, homo sapien
gugacugcgccucugcgcccgcgucuugccgcggcucccgggaugcgcggaggcgguggcgauggcgaugaugccucuaguccugcaucauccagagcggcaggcggagcugggguccggacugcgagauggaggaggggcggcgcugcggccacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaa

SEQ ID NO: 30 - RNA, 1895 nt, homo sapien
gugacugcgccucugcgcccgcgucuugccgcggcucccgggaugcgcggaggcgguggcgauggcgaugaugccucuaguccugcaucauccagagcggcaggcggagcugggguccggacugcgagauggaggaggggcggcgcugcggccacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuauguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugucugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaa

SEQ ID NO: 31 - DNA, 2054 bp, homo sapien
gcgatggcgatgatgcctctagtcctgcatcatccagagcggcaggcgagctggggtccggactgcgagatggaggaggggcgcgctgcggcacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctg

SEQ ID NO: 32 - DNA, 1913 bp, homo sapien
caggcttactgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccctgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacgacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatgggctttattctaacttgagatcagtggcggatcaaaacctacaagattcaactgaaaagttggcagttatggttttctttcatctgatgtgtcagtatctgttgatttgctttgtagtttgttga

SEQ ID NO: 33 - DNA, 1741 bp, homo sapien
ggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatagtggcggatc

SEQ ID NO: 34 - DNA, 1894 bp, homo sapien
gtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaa

SEQ ID NO: 35 - DNA, 2047 bp, homo sapien
gcgatggcgatgatgcctctagtcctgcatcatccagagcggcaggcgagctggggtccggactgcgagatggaggaggggcgcgctgcggcacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctg

SEQ ID NO: 36 - DNA, 2054 bp, homo sapien
gcgatggcgatgatgcctctagtcctgcatcatccagagcggcaggcgagctggggtccggactgcgagatggaggaggggcgcgctgcggcacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatactttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctg

SEQ ID NO: 37 - DNA, 2054 bp, homo sapien
gcgatggcgatgatgcctctagtcctgcatcatccagagcggcaggcgagctggggtccggactgcgagatggaggaggggcgcgctgcggcacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgcttaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctg

SEQ ID NO: 38 - DNA, 2050 bp, homo sapien
gcgatggcgatgatgcctctagtcctgcatcatccagagcggcaggcgagctggggtccggactgcgagatggaggaggggcgcgctgcggcacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctg

SEQ ID NO: 39 - DNA, 2055 bp, homo sapien
gcgatggcgatgatgcctctagtcctgcatcatccagagcggcaggcgagctggggtccggactgcgagatggaggaggggcgcgctgcggcacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgtctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctg

SEQ ID NO: 40 - DNA, 1906 bp, homo sapien
caggcttactgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccctgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacgacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatgggctttattctaacttgagatcagtggcggatcaaaacctacaagattcaactgaaaagttggcagttatggttttctttcatctgatgtgtcagtatctgttgatttgctttgtagtttgttga

SEQ ID NO: 41 - DNA, 1913 bp, homo sapien
caggcttactgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatactttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccctgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacgacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatgggctttattctaacttgagatcagtggcggatcaaaacctacaagattcaactgaaaagttggcagttatggttttctttcatctgatgtgtcagtatctgttgatttgctttgtagtttgttga

SEQ ID NO: 42 - DNA, 1913 bp, homo sapien
caggcttactgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccctgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgcttaagtcagaaagtgcccccctgtaatcacagtcgatgcttccagaccacagcctttcatgggggtccctgtgcagggaggtggagatcccatccagtgtgccatgccggctctgtataggaaccagaattacgacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatgggctttattctaacttgagatcagtggcggatcaaaacctacaagattcaactgaaaagttggcagttatggttttctttcatctgatgtgtcagtatctgttgatttgctttgtagtttgttga

SEQ ID NO: 43 - DNA, 1909 bp, homo sapien
caggcttactgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccctgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagtgcccccctgtaatcacagtcgatgcttccagaccacagcctttcatgggggtccctgtgcagggaggtggagatcccatccagtgtgccatgccggctctgtataggaaccagaattacgacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatgggctttattctaacttgagatcagtggcggatcaaaacctacaagattcaactgaaaagttggcagttatggttttctttcatctgatgtgtcagtatctgttgatttgctttgtagtttgttga

SEQ ID NO: 44 - DNA, 1914 bp, homo sapien
caggcttactgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccctgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacgacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgtctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatgggctttattctaacttgagatcagtggcggatcaaaacctacaagattcaactgaaaagttggcagttatggttttctttcatctgatgtgtcagtatctgttgatttgctttgtagtttgttga

SEQ ID NO: 45 - DNA, 1734 bp, homo sapien
ggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatagtggcggatc

SEQ ID NO: 46 - DNA, 1741 bp, homo sapien
ggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatactttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatagtggcggatc

SEQ ID NO: 47 - DNA, 1741 bp, homo sapien
ggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgcttaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatagtggcggatc

SEQ ID NO: 48 - DNA, 1737 bp, homo sapien
ggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatagtggcggatc

SEQ ID NO: 49 - DNA, 1742 bp, homo sapien
ggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgtctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatagtggcggatc

SEQ ID NO: 50 - DNA, 1887 bp, homo sapien
gtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaa

SEQ ID NO: 51 - DNA, 1894 bp, homo sapien
gtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatactttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaa

SEQ ID NO: 52 - DNA, 1894 bp, homo sapien
gtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgcttaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaa

SEQ ID NO: 53 - DNA, 1890 bp, homo sapien
gtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaa

SEQ ID NO: 54 - DNA, 1895 bp, homo sapien
gtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctatgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgtctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaa

SEQ ID NO: 55 - protein, 540 aa, homo sapien
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSASSIPDAFCFTFHLTSSGFIIMSLKTVAVIALHRLRMVLGKQPNRTASFPCTVLLTLLLWATSFTLATLATLKTSKSHLCLPMSSLIAGKGKAILSLYVVDFTFCVAVVSVSYIMIAQTLRKNAQVRKCPPVITVDASRPQPFMGVPVQGGGDPIQCAMPALYRNQNYNKLQHVQTRGYTKSPNQLVTPAASRLQLVSAINLSTAKDSKAVVTCVIIVLSVLVCCLPLGISLVQVVLSSNGSFILYQFELFGFTLIFFKSGLNPFIYSRNSAGLRRKVLWCLQYIGLGFFCCKQKTRLRAMGKGNLEVNRNKSSHHETNSAYMLSPKPQKKFVDQACGPSHSKESMVSPKISAGHQHCGQSSSTPINTRIEPYYSIYNSSPSQEESSPCNLQPVNSFGFANSYIAMHYHTTNDLVQEYDSTSAKQIPVPSV

SEQ ID NO: 56 - protein, 130 aa, homo sapien
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSVSRMLSASLSISPVQASSSCL

SEQ ID NO: 57 - protein, 540 aa, homo sapien [sequence omitted]

SEQ ID NO: 58 - protein, 233 aa, homo sapien
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSASSIPDAFCFTFHLTSSGFIIMSLKTVAVIALHRLRMVLGKQPNRTASFPCTVLLTLLLWATSFTLATLATLKTSKSHLCLPMSSLIAGKGKAILSLYVVDFTFCVAVVSVSYIMIAQTLRKNA

SEQ ID NO: 59 - protein, 239 aa, homo sapien
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSASSIPDAFCFTFHLTSSGFIIMSLKTVAVIALHRLRMVLGKQPNRTASFPCTVLLTLLLWATSFTLATLATLKTSKSHLCLPMSSLIAGKGKAILSLYVVDFTFCVAVVSVSYIMIAQTLRKNAQVSAPL

SEQ ID NO: 60 - protein, 425 aa, homo sapien
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSASSIPDAFCFTFHLTSSGFIIMSLKTVAVIALHRLRMVLGKQPNRTASFPCTVLLTLLLWATSFTLATLATLKTSKSHLCLPMSSLIAGKGKAILSLYVVDFTFCVAVVSVSYIMIAQTLRKNAQVRKCPPVITVDASRPQPFMGVPVQGGGDPIQCAMPALYRNQNYNKLQHVQTRGYTKSPNQLVTPAASRLQLVSAINLSTAKDSKAVVTCVIIVLSVLVCCLPLGISLVQVVLSSNGSFILYQFELFGFTLIFFKSGLNPFIYSRNSAGLRRKVLWCLQYIGLGFFCLQTKDSTSSHGKREPRSQQKQILPS

SEQ ID NO: 61 - DNA, 23 bp, artificial sequence
  gRNA Recognition Sequence
acaccatccggagccggtgcagg

SEQ ID NO: 62 - DNA, 23 bp, artificial sequence
  gRNA Recognition Sequence
gaaagcatccgggatactactgg

SEQ ID NO: 63 - DNA, 23 bp, artificial sequence
  gRNA Recognition Sequence
tgatcgccctgcaccggctccgg

SEQ ID NO: 64 - DNA, 23 bp, artificial sequence
  gRNA Recognition Sequence
gcaccggctccggatggtgttgg

SEQ ID NO: 65 - DNA, 23 bp, artificial sequence
  gRNA Recognition Sequence
accggctccggatggtgttgggg

SEQ ID NO: 66 - DNA, 23 bp, artificial sequence
  gRNA Recognition Sequence
caccggctccggatggtgttggg

SEQ ID NO: 67 - DNA, 23 bp, artificial sequence
  gRNA Recognition Sequence
ggaaaggaggccgtgcgattagg

SEQ ID NO: 68 - DNA, 23 bp, artificial sequence
  gRNA Recognition Sequence
ggggaaacagcctaatcgcacgg

SEQ ID NO: 69 - DNA, 23 bp, artificial sequence
  gRNA Recognition Sequence
caccatccggagccggtgcaggg

SEQ ID NO: 70 - DNA, 23 bp, artificial sequence
  gRNA Recognition Sequence
tggcagtgatcgccctgcaccgg

SEQ ID NO: 71 - DNA, 23 bp, artificial sequence
  gRNA Recognition Sequence
catgatgatgaagcctgaactgg

SEQ ID NO: 72 - DNA, 23 bp, artificial sequence
  gRNA Recognition Sequence
cgccctgcaccggctccggatgg

SEQ ID NO: 73 - DNA, 23 bp, artificial sequence
  gRNA Recognition Sequence
tccccaacaccatccggagccgg

SEQ ID NO: 74 - DNA, 23 bp, artificial sequence
  gRNA Recognition Sequence
ctgtcactccacaaatgaagagg

SEQ ID NO: 75 - DNA, 23 bp, artificial sequence
  gRNA Recognition Sequence
gacttgagcgttcttccgcaggg

SEQ ID NO: 76 - DNA, 23 bp, artificial sequence
  gRNA Recognition Sequence
gcatcgactgtgattacaggggg

SEQ ID NO: 77 - DNA, 23 bp, artificial sequence
  gRNA Recognition Sequence
gccggcatggcacactggatggg

SEQ ID NO: 78 - DNA, 23 bp, artificial sequence
  gRNA Recognition Sequence
gaagcatcgactgtgattacagg

SEQ ID NO: 79 - DNA, 23 bp, artificial sequence
  gRNA Recognition Sequence
agcatcgactgtgattacagggg

SEQ ID NO: 80 - DNA, 23 bp, artificial sequence
  gRNA Recognition Sequence
tgacttgagcgttcttccgcagg

SEQ ID NO: 81 - DNA, 23 bp, artificial sequence
  gRNA Recognition Sequence
tcatgattgctcagaccctgcgg

SEQ ID NO: 82 - DNA, 23 bp, artificial sequence
  gRNA Recognition Sequence
catcgactgtgattacagggggg

SEQ ID NO: 83 - DNA, 23 bp, artificial sequence
  gRNA Recognition Sequence
aagcatcgactgtgattacaggg

SEQ ID NO: 84 - DNA, 23 bp, artificial sequence
  gRNA Recognition Sequence
tccagaccacagcctttcatggg

SEQ ID NO: 85 - DNA, 23 bp, artificial sequence
  gRNA Recognition Sequence
cccatgtccagtctgattgctgg

SEQ ID NO: 86 - DNA, 23 bp, artificial sequence
  gRNA Recognition Sequence
acagagccggcatggcacactgg

SEQ ID NO: 87 - DNA, 23 bp, artificial sequence
  gRNA Recognition Sequence
cagaccacagcctttcatggggg

SEQ ID NO: 88 - DNA, 23 bp, artificial sequence
  gRNA Recognition Sequence
ttcatgggggtccctgtgcaggg

SEQ ID NO: 89 - DNA, 23 bp, artificial sequence
  gRNA Recognition Sequence
aagactcgacttcgagccatggg

SEQ ID NO: 90 - DNA, 23 bp, artificial sequence
  gRNA Recognition Sequence
aaagactcgacttcgagccatgg

SEQ ID NO: 91 - DNA, 23 bp, artificial sequence
  gRNA Recognition Sequence
cgacttcgagccatgggaaaagg

SEQ ID NO: 92 - DNA, 23 bp, artificial sequence
  gRNA Recognition Sequence
tatattctcggaacagtgcaggg

SEQ ID NO: 93 - DNA, 23 bp, artificial sequence
  gRNA Recognition Sequence
ctctggtgcctccaatacatagg

SEQ ID NO: 94 - DNA, 23 bp, artificial sequence
  gRNA Recognition Sequence
atatattctcggaacagtgcagg

SEQ ID NO: 95 - DNA, 23 bp, artificial sequence
  gRNA Recognition Sequence
tgcctccaatacataggcctggg

SEQ ID NO: 96 - DNA, 23 bp, artificial sequence
  gRNA Recognition Sequence
aacccaggcctatgtattggagg

SEQ ID NO: 97 - DNA, 23 bp, artificial sequence
  gRNA Recognition Sequence
aaaaacccaggcctatgtattgg

SEQ ID NO: 98 - DNA, 23 bp, artificial sequence
  gRNA Recognition Sequence
ttcgaggttcccttttcccatgg

SEQ ID NO: 99 - DNA, 7056 bp, homo sapien
gtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggtgagaggccgcgggcccctggaggaggacaaccccacgatgccggagacggctcccggaggctggcgggatagcgaggagcgcggctgcgctgggccaggcccggctccgcgtacctgtcttcctggtgcggcctgcagggtagccttctcgcccgtccctgccggttcccaggctctgctcggccgtggaaccccccccacccacccacccaccgcccctaccctggctgagccctcctaacccaccacccctctgcggcattcttttgcaagcttacctggcccggcctaggccctccttaccgtcacctcacccttctccgggaagcccctacccaccgccagcccctcacgggggggtcgaccttccctgcccgcagtttcccactctgtcctcaggctgggggctccctggcctcttcatccctcccatcaaatgactcaggtcttcccatcccattagctgctccgggttcaatgtagttctactggatagaaagagcaagggctttgaaatcagataatgaccttggggaagttatctaacctccctgaggttttcctgatcgatagaaatacaatgggaatcacaataatacagaaccttgctctctgtgaggattaggctttgaaaatgctaacctaagacattttggggcgcgcggggaatggggttggaagaattcaggtcgtgagttgatttatgaaagcccctatagcatgttttaatgttcactaaaaatttaaaacagcacactagatatatcagaggctgttcacatatcttaatgaaaaatcattgccactcaaattatacaataaattttcatccatattctttgcttgctagttacttcaggatgtctcatttgtaagaatatgcatgtgaattcattcttactgcagctaatatgcatgcttaagactggtgttccagcttaaaatctttctgattttgtgactttaatcacatcttctataacctattctccgtcccagagatgaagagtagcttgtatgtttgcattgcaaataacatgggtaatctttattgaatatttatgagtagcaaagcagtattaatttattccccttccaaaaccacttttattttctgccgtcatcatgtcattccaaattatggtcacagcctcctttttcttaaagtctcaggagttactactaagacctgagtttactttccctccattttcttgatttctgttatactaaagtttttctgcaaaccttttcgtcttttctgtcctctgctttttctcccttttctcttcccagcccatgattcctttttttctaattatctcaataggagtgatttatgattactttatatgtgaactacagttagatacatagaagaatgtgtgtgtgtgtgtgtgtgtgtgtgtgtgtgtgtgtgtgtctatctgtatctacatagatgtagatatagctatataggtgtatcagaatttcggattccagaaagtttcagtggggaagggattgcaatacctattcataggattattgtgagaatgaaataaagcttgataatttatgtaaagcctctagaataggtgcctggtgtgtaataaccacttaatacttctgacctggggatgcctcccaaaaaggtttttttgttgttcgggttagcatggtggtgaagagtgtggaagagcaactgcttagattcaaatccatgttccaccactttagataacctctctttgacttggtttcctcatctgcaaaatggagatgttatatcaagtatttcagggttgttatgaggactcaataagctaatagtgtggaacattgagaaaagtacctggcacatcataagcacttgataaaattaatatactaataatgatgctgataattatactgccattgttatttcctgacctggaattcttattttttttaatttactgaaggctgggtacagtggctcacacctgtaatctcagcactttgggaggccaaagcaggcagattgcttgagcccagaagttggagaccagtgagggcaacatagtgagactccatctctattaaaaatatatatattgaaaaatttaaaatttgttgaaaaaatgtaactgtacaaaacgtgaaagttgcctctcctctaccccaaatcaccttttttcctcctgcctcctattcttgactaatgttagtgcttcatcatctcatttttctcctaatccctttttccaaatatctcttagcctgaggtcttcataacttccatcatcccgcttcattattacctagttacttttcatttgtcttagcatcctaattccagactcctcattcttctaatttccccaggccaaattcctgcatccctcttcacccctcttcatctctctacctccaaagaggaaacccttggagataagggggttagagacaccagtatcacctccctgctcttcctgcctcctcaaattgttttctcttctacttcccttttcataaattagctgtaatactcctgttagcaacttttaaaaacagtaaaaaattgtctttctcggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaattagccgggcacggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaaaaattgtctttctcattatataggtatcaaaagtgttcagaaacaaatatacagcctttaagtggaaatagagctatctggtactatttttaaaaaattctaaccatcaagaaacaaaagttcaggattttcttctcttatggaacttttatttgaaaggaaagtatagaaaagttggtctcactttccagtggacaaattcaccatatcgtcctgatctgtaccatatgaatgttaagaatatagattaagttatctttttccttgattaaggacaccagtcaattatatggatttcccaggactggtatatgtctgatagtcactggcatggctgtatctgttgttaaatgtggagagacttctgtattgggtagtccatagctgctaattggagccccaggtaatccctgactgacctggttcattccgctgtacccccttgatctggcaactaaagggttaacagctggaggcttctgggatccagcttgagctggtggttaagtacactgaacatcagccctggacctctgcagtgccacttattgttcctaaaattctagattaaggcaaaccctttttggttgtcaagaacatagtgctgtctccaaggaacagcttagtcggtcccaccagaagcatctgttgggagcaggttgggcaccaacccttgcaggactttgggatttgggacaatgtagatttgtgtgagtgcacattaagtctcattgcaaaatagaaaaaaaaaagttaggaaaaaggagcaagaagttattcttttaaagtagagactgccttactcatcgtagcacctagcacctggcgtaatgctggcatatggtatgcacataattaatataaattgagcgaacgaatgcaggaatgggtgcatgcctcctgcttcaccatcaggatattcttgttgggataatggtaactcacatttatatagcagtttagactttacaatgtggtgctttgcaccttgtaaatttctaatataattccaacatccttggttacttccagttttccgtctcacatgtagtcctacacaaggtttttttccaaaggagaatatgtagttaattggccaagaaattgcaagctgggggaaaaattataaatactgggaaataaaggattcttcatagggaacgaaacagggtttgttaatgatttatgggaattatgtgaagggccacattatgcatcaacaataccctccagcctatatttcaagcacatgcagttttttgccgcagtgcttctgctgcaaagacctacccccacttctcttagcctgtctgtccccactccatacccccgacctttcatccagctggcctgtgcttgctaaagctccctttatcctttcccagctccctttccatgttggagtaggttccccccttccatgctctcatagcaccctgcaaccttattaggctgtaattattacatagttagattgatctccaactagattgtcatctctttggtggagagattacgttcttgtgtatcttcagtgcctgacacagaagtgtttctaaaagtaacatctgcacacccctcaaacagaatcacaaggggcgaggccaagaaatctgctctccaagtgataacttaaactttttaacatgctcttcaggtgacacttaaacttgtttgaaaacctctgtgtcataaaactaaatattagctggatgaatgtatttgtatctttttctgtgttggcctttgtgaggagaaatgctgtctatgcaccaaatcagagctgaaaaattctagtgttttgttaaaaaaaaaaaagagagagagagagctgggtttggtggtgcatgcctgtagtcccagctacttgggaagctaagccaggaggactgcttgagcacaggagttcaagtccagcctgggcaacatggtaagaccccattgctaataaatgaataaatttttctctcaaggtgagagatactagtactaatactactactaataatgagatcactgtatgaattcctttctgtttctacattaatccctttctgtttctgggtgtgcatttttgtgtgtaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctgtgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctgc

SEQ ID NO: 100 - RNA, 2054 nt, homo sapien
gcgauggcgaugaugccucuaguccugcaucauccagagcggcaggcgagcugggguccggacugcgagauggaggaggggcgcgcugcggcacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuguguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagaucaguggcggaucaaaaccuacaagauucaacugaaaaguuggcaguuaugguuuucuuucaucugaugugucaguaucuguugauuugcuuuguaguuuguugacaucuuaagauuugaugugaaaguuuuagauuuuuuacccug

SEQ ID NO: 101 - RNA, 1913 nt, homo sapien
caggcuuacugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucaccccugccaccuuggcuaccuugaaaaccagcaagucccaccucugucuucccauguccagucugauugcuggaaaagggaaagccauuuugucucucuguguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacgacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaaugggcuuuauucuaacuugagaucaguggcggaucaaaaccuacaagauucaacugaaaaguuggcaguuaugguuuucuuucaucugaugugucaguaucuguugauuugcuuuguaguuuguuga

SEQ ID NO: 102 - RNA, 1741 nt, homo sapien
ggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuguguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaaagucauggaggcuauaggaucuuauguaaacaguuuuuguuucugauaguaauggacuuuauucuaacuugagauaguggcggauc

SEQ ID NO: 103 - RNA, 1894 nt, homo sapien
gugacugcgccucugcgcccgcgucuugccgcggcucccgggaugcgcggaggcgguggcgauggcgaugaugccucuaguccugcaucauccagagcggcaggcggagcugggguccggacugcgagauggaggaggggcggcgcugcggccacccggcaggcuuaucugucuugggccucuuuugucacauauugcucaucugugagcugaggcccugacucacugaguauuuuuggggagcagaagaaggagacauuucucuccgaaaaugaacucaacaggccaccuucaggaugcccccaaugccaccucgcuccaugugccucacucacaggaaggaaacagcaccucucuccaggagggucuucaggaucucauccacacagccaccuuggugaccuguacuuuucuacuggcggucaucuucugccuggguuccuauggcaacuucauugucuucuuguccuucuucgauccagccuucaggaaauucagaaccaacuuugauuucaugauccugaaccuguccuucugugaccucuucauuuguggagugacagcccccauguucaccuuuguguuauucuucagcucagccaguaguaucccggaugcuuucugcuucacuuuccaucucaccaguucaggcuucaucaucaugucucugaagacaguggcagugaucgcccugcaccggcuccggaugguguuggggaaacagccuaaucgcacggccuccuuucccugcaccguacuccucacccugcuucucugggccaccaguuucacccuugccaccuuggcuaccuugaaaaccagcaagucccaccucugucuucccauguccagucugauugcuggaaaagggaaagccauuuugucucucuguguggucgacuucaccuucuguguugcuguggucucugucucuuacaucaugauugcucagacccugcggaagaacgcucaagucagaaagugccccccuguaaucacagucgaugcuuccagaccacagccuuucaugggggucccugugcagggagguggagaucccauccagugugccaugccggcucuguauaggaaccagaauuacaacaaacugcagcacguucagacccguggauauaccaagagucccaaccaacuggucaccccugcagcaagccgacuccagcucguaucagccaucaaccucuccacugccaaggauuccaaagccguggucaccugugugaucauugugcugucaguccuggugugcugucuuccacuggggauuuccuugguacaggugguucucuccagcaaugggagcuucauucuuuaccaguuugaauuguuuggauuuacucuuauauuuuucaagucaggauuaaacccuuuuauauauucucggaacagugcagggcugagaaggaaagugcucuggugccuccaauacauaggccuggguuuuuucugcugcaaacaaaagacucgacuucgagccaugggaaaagggaaccucgaagucaacagaaacaaauccucccaucaugaaacaaacucugccuacauguuaucuccaaagccacagaagaaauuuguggaccaggcuuguggcccaagucauucaaaagaaaguauggugagucccaagaucucugcuggacaucaacacuguggucagagcagcucgacccccaucaacacucggauugaaccuuacuacagcaucuauaacagcagcccuucccaggaggagagcagcccauguaacuuacagccaguaaacucuuuuggauuugccaauucauauauugccaugcauuaucacaccacuaaugacuuagugcaggaauaugacagcacuucagccaagcagauuccaguccccuccguuuaa

SEQ ID NO: 104 - DNA, 2054 bp, homo sapien
gcgatggcgatgatgcctctagtcctgcatcatccagagcggcaggcgagctggggtccggactgcgagatggaggaggggcgcgctgcggcacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctgtgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatcagtggcggatcaaaacctacaagattcaactgaaaagttggcagttatggttttctttcatctgatgtgtcagtatctgttgatttgctttgtagtttgttgacatcttaagatttgatgtgaaagttttagattttttaccctg

SEQ ID NO: 105 - DNA, 1913 bp, homo sapien
caggcttactgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccctgccaccttggctaccttgaaaaccagcaagtcccacctctgtcttcccatgtccagtctgattgctggaaaagggaaagccattttgtctctctgtgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacgacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatgggctttattctaacttgagatcagtggcggatcaaaacctacaagattcaactgaaaagttggcagttatggttttctttcatctgatgtgtcagtatctgttgatttgctttgtagtttgttga

SEQ ID NO: 106 - DNA, 1741 bp, homo sapien
ggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctgtgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaaagtcatggaggctataggatcttatgtaaacagtttttgtttctgatagtaatggactttattctaacttgagatagtggcggatc

SEQ ID NO: 107 - DNA, 1894 bp, homo sapien
gtgactgcgcctctgcgcccgcgtcttgccgcggctcccgggatgcgcggaggcggtggcgatggcgatgatgcctctagtcctgcatcatccagagcggcaggcggagctggggtccggactgcgagatggaggaggggcggcgctgcggccacccggcaggcttatctgtcttgggcctcttttgtcacatattgctcatctgtgagctgaggccctgactcactgagtatttttggggagcagaagaaggagacatttctctccgaaaatgaactcaacaggccaccttcaggatgcccccaatgccacctcgctccatgtgcctcactcacaggaaggaaacagcacctctctccaggagggtcttcaggatctcatccacacagccaccttggtgacctgtacttttctactggcggtcatcttctgcctgggttcctatggcaacttcattgtcttcttgtccttcttcgatccagccttcaggaaattcagaaccaactttgatttcatgatcctgaacctgtccttctgtgacctcttcatttgtggagtgacagcccccatgttcacctttgtgttattcttcagctcagccagtagtatcccggatgctttctgcttcactttccatctcaccagttcaggcttcatcatcatgtctctgaagacagtggcagtgatcgccctgcaccggctccggatggtgttggggaaacagcctaatcgcacggcctcctttccctgcaccgtactcctcaccctgcttctctgggccaccagtttcacccttgccaccttggctaccttgaaaaccagcaagtcccacctctgtcttcccatgtccagtctgattgctggaaaagggaaagccattttgtctctctgtgtggtcgacttcaccttctgtgttgctgtggtctctgtctcttacatcatgattgctcagaccctgcggaagaacgctcaagtcagaaagtgcccccctgtaatcacagtcgatgcttccagaccacagcctttcatgggggtccctgtgcagggaggtggagatcccatccagtgtgccatgccggctctgtataggaaccagaattacaacaaactgcagcacgttcagacccgtggatataccaagagtcccaaccaactggtcacccctgcagcaagccgactccagctcgtatcagccatcaacctctccactgccaaggattccaaagccgtggtcacctgtgtgatcattgtgctgtcagtcctggtgtgctgtcttccactggggatttccttggtacaggtggttctctccagcaatgggagcttcattctttaccagtttgaattgtttggatttactcttatatttttcaagtcaggattaaacccttttatatattctcggaacagtgcagggctgagaaggaaagtgctctggtgcctccaatacataggcctgggttttttctgctgcaaacaaaagactcgacttcgagccatgggaaaagggaacctcgaagtcaacagaaacaaatcctcccatcatgaaacaaactctgcctacatgttatctccaaagccacagaagaaatttgtggaccaggcttgtggcccaagtcattcaaaagaaagtatggtgagtcccaagatctctgctggacatcaacactgtggtcagagcagctcgacccccatcaacactcggattgaaccttactacagcatctataacagcagcccttcccaggaggagagcagcccatgtaacttacagccagtaaactcttttggatttgccaattcatatattgccatgcattatcacaccactaatgacttagtgcaggaatatgacagcacttcagccaagcagattccagtcccctccgtttaa

SEQ ID NO: 108 - protein, 540 aa, homo sapien
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSASSIPDAFCFTFHLTSSGFIIMSLKTVAVIALHRLRMVLGKQPNRTASFPCTVLLTLLLWATSFTLATLATLKTSKSHLCLPMSSLIAGKGKAILSLCVVDFTFCVAVVSVSYIMIAQTLRKNAQVRKCPPVITVDASRPQPFMGVPVQGGGDPIQCAMPALYRNQNYNKLQHVQTRGYTKSPNQLVTPAASRLQLVSAINLSTAKDSKAVVTCVIIVLSVLVCCLPLGISLVQVVLSSNGSFILYQFELFGFTLIFFKSGLNPFIYSRNSAGLRRKVLWCLQYIGLGFFCCKQKTRLRAMGKGNLEVNRNKSSHHETNSAYMLSPKPQKKFVDQACGPSHSKESMVSPKISAGHQHCGQSSSTPINTRIEPYYSIYNSSPSQEESSPCNLQPVNSFGFANSYIAMHYHTTNDLVQEYDSTSAKQIPVPSV

SEQ ID NO: 109 - RNA, 20 nt, artificial sequence
  Synthetic sequence; antisense nucleic acid molecule
aggcaucaucgccaucgcca

SEQ ID NO: 110 - RNA, 20 nt, artificial sequence
  Synthetic sequence; antisense nucleic acid molecule
agaggcaucaucgccaucgc

SEQ ID NO: 111 - RNA, 20 nt, artificial sequence
  Synthetic sequence; antisense nucleic acid molecule
uagaggcaucaucgccaucg

SEQ ID NO: 112 - RNA, 20 nt, artificial sequence
  Synthetic sequence; antisense nucleic acid molecule
cuagaggcaucaucgccauc

SEQ ID NO: 113 - RNA, 20 nt, artificial sequence
  Synthetic sequence; antisense nucleic acid molecule
acuagaggcaucaucgccau

SEQ ID NO: 114 - RNA, 20 nt, artificial sequence
  Synthetic sequence; antisense nucleic acid molecule
gacuagaggcaucaucgcca

SEQ ID NO: 115 - RNA, 20 nt, artificial sequence
  Synthetic sequence; antisense nucleic acid molecule
ggacuagaggcaucaucgcc

SEQ ID NO: 116 - RNA, 20 nt, artificial sequence
  Synthetic sequence; antisense nucleic acid molecule
aggacuagaggcaucaucgc

SEQ ID NO: 117 - RNA, 20 nt, artificial sequence
  Synthetic sequence; antisense nucleic acid molecule
caggacuagaggcaucaucg

SEQ ID NO: 118 - RNA, 20 nt, artificial sequence
  Synthetic sequence; antisense nucleic acid molecule
gcaggacuagaggcaucauc

SEQ ID NO: 119 - RNA, 20 nt, artificial sequence
  Synthetic sequence; antisense nucleic acid molecule
ugcaggacuagaggcaucau

SEQ ID NO: 120 - RNA, 20 nt, artificial sequence
  Synthetic sequence; antisense nucleic acid molecule
gaugaugcaggacuagaggc

SEQ ID NO: 121 - RNA, 20 nt, artificial sequence
  Synthetic sequence; antisense nucleic acid molecule
ggaugaugcaggacuagagg

SEQ ID NO: 122 - RNA, 20 nt, artificial sequence
  Synthetic sequence; antisense nucleic acid molecule
uggaugaugcaggacuagag

SEQ ID NO: 123 - RNA, 20 nt, artificial sequence
  Synthetic sequence; antisense nucleic acid molecule
cuggaugaugcaggacuaga

SEQ ID NO: 124 - RNA, 20 nt, artificial sequence
  Synthetic sequence; antisense nucleic acid molecule
ucuggaugaugcaggacuag

SEQ ID NO: 125 - RNA, 20 nt, artificial sequence
  Synthetic sequence; antisense nucleic acid molecule
cucuggaugaugcaggacua

SEQ ID NO: 126 - RNA, 20 nt, artificial sequence
  Synthetic sequence; antisense nucleic acid molecule
cgcucuggaugaugcaggac

SEQ ID NO: 127 - RNA, 20 nt, artificial sequence
  Synthetic sequence; antisense nucleic acid molecule
ugccgcucuggaugaugcag

SEQ ID NO: 128 - RNA, 20 nt, artificial sequence
  Synthetic sequence; antisense nucleic acid molecule
cugccgcucuggaugaugca

SEQ ID NO: 129 - RNA, 20 nt, artificial sequence
  Synthetic sequence; antisense nucleic acid molecule
aagacagauaagccugccgg

SEQ ID NO: 130 - RNA, 20 nt, artificial sequence
  Synthetic sequence; antisense nucleic acid molecule
caagacagauaagccugccg

SEQ ID NO: 131 - RNA, 20 nt, artificial sequence
  Synthetic sequence; antisense nucleic acid molecule
ggcccaagacagauaagccu

SEQ ID NO: 132 - RNA, 20 nt, artificial sequence
  Synthetic sequence; antisense nucleic acid molecule
gaggcccaagacagauaagc

SEQ ID NO: 133 - RNA, 20 nt, artificial sequence
  Synthetic sequence; antisense nucleic acid molecule
ugacaaaagaggcccaagac

SEQ ID NO: 134 - RNA, 20 nt, artificial sequence
  Synthetic sequence; antisense nucleic acid molecule
ugugacaaaagaggcccaag

SEQ ID NO: 135 - RNA, 20 nt, artificial sequence
  Synthetic sequence; antisense nucleic acid molecule
augugacaaaagaggcccaa

SEQ ID NO: 136 - RNA, 20 nt, artificial sequence
  Synthetic sequence; antisense nucleic acid molecule
uaugugacaaaagaggccca

SEQ ID NO: 137 - RNA, 20 nt, artificial sequence
  Synthetic sequence; antisense nucleic acid molecule
gcaauaugugacaaaagagg

SEQ ID NO: 138 - RNA, 20 nt, artificial sequence
  Synthetic sequence; antisense nucleic acid molecule
acagaugagcaauaugugac

SEQ ID NO: 139 - RNA, 20 nt, artificial sequence
  Synthetic sequence; antisense nucleic acid molecule
uaggaacccaggcagaagau

SEQ ID NO: 140 - RNA, 20 nt, artificial sequence
  Synthetic sequence; antisense nucleic acid molecule
ccauaggaacccaggcagaa

SEQ ID NO: 141 - RNA, 20 nt, artificial sequence
  Synthetic sequence; antisense nucleic acid molecule
gccauaggaacccaggcaga

SEQ ID NO: 142 - RNA, 20 nt, artificial sequence
  Synthetic sequence; antisense nucleic acid molecule
guugccauaggaacccaggc

SEQ ID NO: 143 - RNA, 20 nt, artificial sequence
  Synthetic sequence; antisense nucleic acid molecule
aguugccauaggaacccagg

SEQ ID NO: 144 - RNA, 20 nt, artificial sequence
  Synthetic sequence; antisense nucleic acid molecule
gaaguugccauaggaaccca

SEQ ID NO: 145 - RNA, 20 nt, artificial sequence
  Synthetic sequence; antisense nucleic acid molecule
ugaaguugccauaggaaccc

SEQ ID NO: 146 - RNA, 20 nt, artificial sequence
  Synthetic sequence; antisense nucleic acid molecule
augaaguugccauaggaacc

SEQ ID NO: 147 - RNA, 20 nt, artificial sequence
  Synthetic sequence; antisense nucleic acid molecule
caaugaaguugccauaggaa

SEQ ID NO: 148 - RNA, 20 nt, artificial sequence
  Synthetic sequence; antisense nucleic acid molecule
acaaugaaguugccauagga

SEQ ID NO: 149 - RNA, 20 nt, artificial sequence
  Synthetic sequence; antisense nucleic acid molecule
gacaaugaaguugccauagg

SEQ ID NO: 150 - RNA, 20 nt, artificial sequence
  Synthetic sequence; antisense nucleic acid molecule
agacaaugaaguugccauag

SEQ ID NO: 151 - RNA, 20 nt, artificial sequence
  Synthetic sequence; antisense nucleic acid molecule
gaagacaaugaaguugccau

SEQ ID NO: 152 - RNA, 20 nt, artificial sequence
  Synthetic sequence; antisense nucleic acid molecule
gaucgaagaaggacaagaag

SEQ ID NO: 153 - RNA, 20 nt, artificial sequence
  Synthetic sequence; antisense nucleic acid molecule
ggaucgaagaaggacaagaa

SEQ ID NO: 154 - RNA, 20 nt, artificial sequence
  Synthetic sequence; antisense nucleic acid molecule
uggaucgaagaaggacaaga

SEQ ID NO: 155 - RNA, 20 nt, artificial sequence
  Synthetic sequence; antisense nucleic acid molecule
cuggaucgaagaaggacaag

SEQ ID NO: 156 - RNA, 20 nt, artificial sequence
  Synthetic sequence; antisense nucleic acid molecule
gcuggaucgaagaaggacaa

SEQ ID NO: 157 - RNA, 20 nt, artificial sequence
  Synthetic sequence; antisense nucleic acid molecule
ggcuggaucgaagaaggaca

SEQ ID NO: 158 - RNA, 20 nt, artificial sequence
  Synthetic sequence; antisense nucleic acid molecule
aggcuggaucgaagaaggac

SEQ ID NO: 159 - RNA, 20 nt, artificial sequence
  Synthetic sequence; antisense nucleic acid molecule
aaggcuggaucgaagaagga

SEQ ID NO: 160 - RNA, 20 nt, artificial sequence
  Synthetic sequence; antisense nucleic acid molecule
gaaggcuggaucgaagaagg

SEQ ID NO: 161 - RNA, 20 nt, artificial sequence
  Synthetic sequence; antisense nucleic acid molecule
ugaaggcuggaucgaagaag

SEQ ID NO: 162 - RNA, 20 nt, artificial sequence
  Synthetic sequence; antisense nucleic acid molecule
cugaaggcuggaucgaagaa

SEQ ID NO: 163 - RNA, 20 nt, artificial sequence
  Synthetic sequence; antisense nucleic acid molecule
ccugaaggcuggaucgaaga

SEQ ID NO: 164 - RNA, 20 nt, artificial sequence
  Synthetic sequence; antisense nucleic acid molecule
uccugaaggcuggaucgaag

SEQ ID NO: 165 - RNA, 20 nt, artificial sequence
  Synthetic sequence; antisense nucleic acid molecule
uuccugaaggcuggaucgaa

SEQ ID NO: 166 - RNA, 20 nt, artificial sequence
  Synthetic sequence; antisense nucleic acid molecule
uuuccugaaggcuggaucga

SEQ ID NO: 167 - RNA, 20 nt, artificial sequence
  Synthetic sequence; antisense nucleic acid molecule
guugguucugaauuuccuga

SEQ ID NO: 168 - RNA, 20 nt, artificial sequence
  Synthetic sequence; antisense nucleic acid molecule
acagaaggacagguucagga

SEQ ID NO: 169 - RNA, 20 nt, artificial sequence
  Synthetic sequence; antisense nucleic acid molecule
cacagaaggacagguucagg

SEQ ID NO: 170 - RNA, 20 nt, artificial sequence
  Synthetic sequence; antisense nucleic acid molecule
ucacagaaggacagguucag

SEQ ID NO: 171 - RNA, 20 nt, artificial sequence
  Synthetic sequence; antisense nucleic acid molecule
gucacagaaggacagguuca

SEQ ID NO: 172 - RNA, 20 nt, artificial sequence
  Synthetic sequence; antisense nucleic acid molecule
gaggucacagaaggacaggu

SEQ ID NO: 173 - RNA, 20 nt, artificial sequence
  Synthetic sequence; antisense nucleic acid molecule
augaagaggucacagaagga

SEQ ID NO: 174 - RNA, 20 nt, artificial sequence
  Synthetic sequence; antisense nucleic acid molecule
ucacuccacaaaugaagagg

SEQ ID NO: 175 - RNA, 20 nt, artificial sequence
  Synthetic sequence; antisense nucleic acid molecule
gucacuccacaaaugaagag

SEQ ID NO: 176 - RNA, 20 nt, artificial sequence
  Synthetic sequence; antisense nucleic acid molecule
gcugucacuccacaaaugaa

SEQ ID NO: 177 - RNA, 20 nt, artificial sequence
  Synthetic sequence; antisense nucleic acid molecule
ggcugucacuccacaaauga

SEQ ID NO: 178 - RNA, 20 nt, artificial sequence
  Synthetic sequence; antisense nucleic acid molecule
gggcugucacuccacaaaug

SEQ ID NO: 179 - RNA, 20 nt, artificial sequence
  Synthetic sequence; antisense nucleic acid molecule
uaacacaaaggugaacaugg

SEQ ID NO: 180 - RNA, 20 nt, artificial sequence
  Synthetic sequence; antisense nucleic acid molecule
gcugaagaauaacacaaagg

SEQ ID NO: 181 - RNA, 20 nt, artificial sequence
  Synthetic sequence; antisense nucleic acid molecule
uggcugagcugaagaauaac

SEQ ID NO: 182 - RNA, 20 nt, artificial sequence
  Synthetic sequence; antisense nucleic acid molecule
guucuuccgcagggucugag

SEQ ID NO: 183 - RNA, 20 nt, artificial sequence
  Synthetic sequence; antisense nucleic acid molecule
cguucuuccgcagggucuga

SEQ ID NO: 184 - RNA, 20 nt, artificial sequence
  Synthetic sequence; antisense nucleic acid molecule
agcguucuuccgcagggucu

SEQ ID NO: 185 - RNA, 20 nt, artificial sequence
  Synthetic sequence; antisense nucleic acid molecule
ugagcguucuuccgcagggu

SEQ ID NO: 186 - RNA, 20 nt, artificial sequence
  Synthetic sequence; antisense nucleic acid molecule
uugagcguucuuccgcaggg

SEQ ID NO: 187 - RNA, 20 nt, artificial sequence
  Synthetic sequence; antisense nucleic acid molecule
cuugagcguucuuccgcagg

SEQ ID NO: 188 - RNA, 20 nt, artificial sequence
  Synthetic sequence; antisense nucleic acid molecule
acuugagcguucuuccgcag

SEQ ID NO: 189 - RNA, 20 nt, artificial sequence
  Synthetic sequence; antisense nucleic acid molecule
gacuugagcguucuuccgca

SEQ ID NO: 190 - RNA, 20 nt, artificial sequence
  Synthetic sequence; antisense nucleic acid molecule
ugacuugagcguucuuccgc

SEQ ID NO: 191 - RNA, 20 nt, artificial sequence
  Synthetic sequence; antisense nucleic acid molecule
cugacuugagcguucuuccg

SEQ ID NO: 192 - RNA, 20 nt, artificial sequence
  Synthetic sequence; antisense nucleic acid molecule
ucugacuugagcguucuucc

SEQ ID NO: 193 - RNA, 20 nt, artificial sequence
  Synthetic sequence; antisense nucleic acid molecule
uucugacuugagcguucuuc

SEQ ID NO: 194 - RNA, 20 nt, artificial sequence
  Synthetic sequence; antisense nucleic acid molecule
uuucugacuugagcguucuu

SEQ ID NO: 195 - RNA, 20 nt, artificial sequence
  Synthetic sequence; antisense nucleic acid molecule
cuuucugacuugagcguucu

SEQ ID NO: 196 - RNA, 20 nt, artificial sequence
  Synthetic sequence; antisense nucleic acid molecule
acuuucugacuugagcguuc

SEQ ID NO: 197 - RNA, 20 nt, artificial sequence
  Synthetic sequence; antisense nucleic acid molecule
cacuuucugacuugagcguu

SEQ ID NO: 198 - RNA, 20 nt, artificial sequence
  Synthetic sequence; antisense nucleic acid molecule
gcacuuucugacuugagcgu

SEQ ID NO: 199 - RNA, 20 nt, artificial sequence
  Synthetic sequence; antisense nucleic acid molecule
ggcacuuucugacuugagcg

SEQ ID NO: 200 - RNA, 20 nt, artificial sequence
  Synthetic sequence; antisense nucleic acid molecule
aagcaucgacugugauuaca

SEQ ID NO: 201 - RNA, 20 nt, artificial sequence
  Synthetic sequence; antisense nucleic acid molecule
gaagcaucgacugugauuac

SEQ ID NO: 202 - RNA, 20 nt, artificial sequence
  Synthetic sequence; antisense nucleic acid molecule
ggaagcaucgacugugauua

SEQ ID NO: 203 - RNA, 20 nt, artificial sequence
  Synthetic sequence; antisense nucleic acid molecule
uggaagcaucgacugugauu

SEQ ID NO: 204 - RNA, 20 nt, artificial sequence
  Synthetic sequence; antisense nucleic acid molecule
cuggaagcaucgacugugau

SEQ ID NO: 205 - RNA, 20 nt, artificial sequence
  Synthetic sequence; antisense nucleic acid molecule
ucuggaagcaucgacuguga

SEQ ID NO: 206 - RNA, 20 nt, artificial sequence
  Synthetic sequence; antisense nucleic acid molecule
gucuggaagcaucgacugug

SEQ ID NO: 207 - RNA, 20 nt, artificial sequence
  Synthetic sequence; antisense nucleic acid molecule
ggucuggaagcaucgacugu

SEQ ID NO: 208 - RNA, 20 nt, artificial sequence
  Synthetic sequence; antisense nucleic acid molecule
uggucuggaagcaucgacug

SEQ ID NO: 209 - RNA, 20 nt, artificial sequence
  Synthetic sequence; antisense nucleic acid molecule
guggucuggaagcaucgacu

SEQ ID NO: 210 - RNA, 20 nt, artificial sequence
  Synthetic sequence; antisense nucleic acid molecule
uguggucuggaagcaucgac

SEQ ID NO: 211 - RNA, 20 nt, artificial sequence
  Synthetic sequence; antisense nucleic acid molecule
gcuguggucuggaagcaucg

SEQ ID NO: 212 - RNA, 20 nt, artificial sequence
  Synthetic sequence; antisense nucleic acid molecule
ggcuguggucuggaagcauc

SEQ ID NO: 213 - RNA, 20 nt, artificial sequence
  Synthetic sequence; antisense nucleic acid molecule
ccaugaaaggcuguggucug

SEQ ID NO: 214 - RNA, 20 nt, artificial sequence
  Synthetic sequence; antisense nucleic acid molecule
cccaugaaaggcuguggucu

SEQ ID NO: 215 - RNA, 20 nt, artificial sequence
  Synthetic sequence; antisense nucleic acid molecule
aucuccaccucccugcacag

SEQ ID NO: 216 - RNA, 20 nt, artificial sequence
  Synthetic sequence; antisense nucleic acid molecule
gcacacuggaugggaucucc

SEQ ID NO: 217 - RNA, 20 nt, artificial sequence
  Synthetic sequence; antisense nucleic acid molecule
ggcacacuggaugggaucuc

SEQ ID NO: 218 - RNA, 20 nt, artificial sequence
  Synthetic sequence; antisense nucleic acid molecule
ugguuccuauacagagccgg

SEQ ID NO: 219 - RNA, 20 nt, artificial sequence
  Synthetic sequence; antisense nucleic acid molecule
cugguuccuauacagagccg

SEQ ID NO: 220 - RNA, 20 nt, artificial sequence
  Synthetic sequence; antisense nucleic acid molecule
ugggacucuugguauaucca

SEQ ID NO: 221 - RNA, 20 nt, artificial sequence
  Synthetic sequence; antisense nucleic acid molecule
uugggacucuugguauaucc

SEQ ID NO: 222 - RNA, 20 nt, artificial sequence
  Synthetic sequence; antisense nucleic acid molecule
guugggacucuugguauauc

SEQ ID NO: 223 - RNA, 20 nt, artificial sequence
  Synthetic sequence; antisense nucleic acid molecule
gguugggacucuugguauau

SEQ ID NO: 224 - RNA, 20 nt, artificial sequence
  Synthetic sequence; antisense nucleic acid molecule
ugguugggacucuugguaua

SEQ ID NO: 225 - RNA, 20 nt, artificial sequence
  Synthetic sequence; antisense nucleic acid molecule
uugguugggacucuugguau

SEQ ID NO: 226 - RNA, 20 nt, artificial sequence
  Synthetic sequence; antisense nucleic acid molecule
ucuguugacuucgagguucc

SEQ ID NO: 227 - RNA, 20 nt, artificial sequence
  Synthetic sequence; antisense nucleic acid molecule
uucuguugacuucgagguuc

SEQ ID NO: 228 - RNA, 20 nt, artificial sequence
  Synthetic sequence; antisense nucleic acid molecule
uuucuguugacuucgagguu

SEQ ID NO: 229 - RNA, 20 nt, artificial sequence
  Synthetic sequence; antisense nucleic acid molecule
guuucuguugacuucgaggu

SEQ ID NO: 230 - RNA, 20 nt, artificial sequence
  Synthetic sequence; antisense nucleic acid molecule
gaugggaggauuuguuucug

SEQ ID NO: 231 - RNA, 20 nt, artificial sequence
  Synthetic sequence; antisense nucleic acid molecule
ugaugggaggauuuguuucu

SEQ ID NO: 232 - RNA, 20 nt, artificial sequence
  Synthetic sequence; antisense nucleic acid molecule
caugaugggaggauuuguuu

SEQ ID NO: 233 - RNA, 20 nt, artificial sequence
  Synthetic sequence; antisense nucleic acid molecule
cauguaggcagaguuuguuu

SEQ ID NO: 234 - RNA, 20 nt, artificial sequence
  Synthetic sequence; antisense nucleic acid molecule
guggcuuuggagauaacaug

SEQ ID NO: 235 - RNA, 20 nt, artificial sequence
  Synthetic sequence; antisense nucleic acid molecule
uguggcuuuggagauaacau

SEQ ID NO: 236 - RNA, 20 nt, artificial sequence
  Synthetic sequence; antisense nucleic acid molecule
gggacucaccauacuuucuu

SEQ ID NO: 237 - RNA, 20 nt, artificial sequence
  Synthetic sequence; antisense nucleic acid molecule
guugauguccagcagagauc

SEQ ID NO: 238 - RNA, 20 nt, artificial sequence
  Synthetic sequence; antisense nucleic acid molecule
uguugauguccagcagagau

SEQ ID NO: 239 - RNA, 20 nt, artificial sequence
  Synthetic sequence; antisense nucleic acid molecule
aguguugauguccagcagag

SEQ ID NO: 240 - RNA, 20 nt, artificial sequence
  Synthetic sequence; antisense nucleic acid molecule
caguguugauguccagcaga

SEQ ID NO: 241 - RNA, 20 nt, artificial sequence
  Synthetic sequence; antisense nucleic acid molecule
acaguguugauguccagcag

SEQ ID NO: 242 - RNA, 20 nt, artificial sequence
  Synthetic sequence; antisense nucleic acid molecule
cacaguguugauguccagca

SEQ ID NO: 243 - RNA, 20 nt, artificial sequence
  Synthetic sequence; antisense nucleic acid molecule
gaccacaguguugaugucca

SEQ ID NO: 244 - RNA, 20 nt, artificial sequence
  Synthetic sequence; antisense nucleic acid molecule
ugaccacaguguugaugucc

SEQ ID NO: 245 - RNA, 20 nt, artificial sequence
  Synthetic sequence; antisense nucleic acid molecule
cugaccacaguguugauguc

SEQ ID NO: 246 - RNA, 20 nt, artificial sequence
  Synthetic sequence; antisense nucleic acid molecule
cucugaccacaguguugaug

SEQ ID NO: 247 - RNA, 20 nt, artificial sequence
  Synthetic sequence; antisense nucleic acid molecule
gcucugaccacaguguugau

SEQ ID NO: 248 - RNA, 20 nt, artificial sequence
  Synthetic sequence; antisense nucleic acid molecule
ugcucugaccacaguguuga

SEQ ID NO: 249 - RNA, 20 nt, artificial sequence
  Synthetic sequence; antisense nucleic acid molecule
aagguucaauccgaguguug

SEQ ID NO: 250 - RNA, 20 nt, artificial sequence
  Synthetic sequence; antisense nucleic acid molecule
gaguucauuuucggagagaa

SEQ ID NO: 251 - RNA, 20 nt, artificial sequence
  Synthetic sequence; antisense nucleic acid molecule
ugaguucauuuucggagaga

SEQ ID NO: 252 - RNA, 20 nt, artificial sequence
  Synthetic sequence; antisense nucleic acid molecule
uugaguucauuuucggagag

SEQ ID NO: 253 - RNA, 20 nt, artificial sequence
  Synthetic sequence; antisense nucleic acid molecule
ccuguugaguucauuuucgg

SEQ ID NO: 254 - RNA, 20 nt, artificial sequence
  Synthetic sequence; antisense nucleic acid molecule
gccuguugaguucauuuucg

SEQ ID NO: 255 - RNA, 20 nt, artificial sequence
  Synthetic sequence; antisense nucleic acid molecule
guggccuguugaguucauuu

SEQ ID NO: 256 - RNA, 20 nt, artificial sequence
  Synthetic sequence; antisense nucleic acid molecule
gguggccuguugaguucauu

SEQ ID NO: 257 - RNA, 20 nt, artificial sequence
  Synthetic sequence; antisense nucleic acid molecule
agguggccuguugaguucau

SEQ ID NO: 258 - RNA, 20 nt, artificial sequence
  Synthetic sequence; antisense nucleic acid molecule
aagguggccuguugaguuca

SEQ ID NO: 259 - RNA, 20 nt, artificial sequence
  Synthetic sequence; antisense nucleic acid molecule
gaagguggccuguugaguuc

SEQ ID NO: 260 - RNA, 20 nt, artificial sequence
  Synthetic sequence; antisense nucleic acid molecule
cugaagguggccuguugagu

SEQ ID NO: 261 - RNA, 20 nt, artificial sequence
  Synthetic sequence; antisense nucleic acid molecule
uccugaagguggccuguuga

SEQ ID NO: 262 - RNA, 20 nt, artificial sequence
  Synthetic sequence; antisense nucleic acid molecule
auccugaagguggccuguug

SEQ ID NO: 263 - RNA, 20 nt, artificial sequence
  Synthetic sequence; antisense nucleic acid molecule
cauccugaagguggccuguu

SEQ ID NO: 264 - RNA, 20 nt, artificial sequence
  Synthetic sequence; antisense nucleic acid molecule
auggagcgagguggcauugg

SEQ ID NO: 265 - RNA, 20 nt, artificial sequence
  Synthetic sequence; antisense nucleic acid molecule
cauggagcgagguggcauug

SEQ ID NO: 266 - RNA, 20 nt, artificial sequence
  Synthetic sequence; antisense nucleic acid molecule
acauggagcgagguggcauu

SEQ ID NO: 267 - RNA, 20 nt, artificial sequence
  Synthetic sequence; antisense nucleic acid molecule
cacauggagcgagguggcau

SEQ ID NO: 268 - RNA, 20 nt, artificial sequence
  Synthetic sequence; antisense nucleic acid molecule
ugaggcacauggagcgaggu

SEQ ID NO: 269 - RNA, 20 nt, artificial sequence
  Synthetic sequence; antisense nucleic acid molecule
gagugaggcacauggagcga

SEQ ID NO: 270 - RNA, 20 nt, artificial sequence
  Synthetic sequence; antisense nucleic acid molecule
ugagugaggcacauggagcg

SEQ ID NO: 271 - RNA, 20 nt, artificial sequence
  Synthetic sequence; antisense nucleic acid molecule
ccuuccugugagugaggcac

SEQ ID NO: 272 - RNA, 20 nt, artificial sequence
  Synthetic sequence; antisense nucleic acid molecule
uccuuccugugagugaggca

SEQ ID NO: 273 - RNA, 20 nt, artificial sequence
  Synthetic sequence; antisense nucleic acid molecule
uuccuuccugugagugaggc

SEQ ID NO: 274 - RNA, 20 nt, artificial sequence
  Synthetic sequence; antisense nucleic acid molecule
ggugcuguuuccuuccugug

SEQ ID NO: 275 - RNA, 20 nt, artificial sequence
  Synthetic sequence; antisense nucleic acid molecule
gagagaggugcuguuuccuu

SEQ ID NO: 276 - RNA, 20 nt, artificial sequence
  Synthetic sequence; antisense nucleic acid molecule
uggagagaggugcuguuucc

SEQ ID NO: 277 - RNA, 20 nt, artificial sequence
  Synthetic sequence; antisense nucleic acid molecule
ccuggagagaggugcuguuu

SEQ ID NO: 278 - RNA, 20 nt, artificial sequence
  Synthetic sequence; antisense nucleic acid molecule
ugaagacccuccuggagaga

SEQ ID NO: 279 - RNA, 20 nt, artificial sequence
  Synthetic sequence; antisense nucleic acid molecule
cugaagacccuccuggagag

SEQ ID NO: 280 - RNA, 20 nt, artificial sequence
  Synthetic sequence; antisense nucleic acid molecule
cuggcugagcugaagaauaa

SEQ ID NO: 281 - RNA, 20 nt, artificial sequence
  Synthetic sequence; antisense nucleic acid molecule
acuggcugagcugaagaaua

SEQ ID NO: 282 - RNA, 20 nt, artificial sequence
  Synthetic sequence; antisense nucleic acid molecule
acuacuggcugagcugaaga

SEQ ID NO: 283 - RNA, 20 nt, artificial sequence
  Synthetic sequence; antisense nucleic acid molecule
uacuacuggcugagcugaag

SEQ ID NO: 284 - RNA, 20 nt, artificial sequence
  Synthetic sequence; antisense nucleic acid molecule
auacuacuggcugagcugaa

SEQ ID NO: 285 - RNA, 20 nt, artificial sequence
  Synthetic sequence; antisense nucleic acid molecule
gauacuacuggcugagcuga

SEQ ID NO: 286 - RNA, 20 nt, artificial sequence
  Synthetic sequence; antisense nucleic acid molecule
ggauacuacuggcugagcug

SEQ ID NO: 287 - RNA, 20 nt, artificial sequence
  Synthetic sequence; antisense nucleic acid molecule
gggauacuacuggcugagcu

SEQ ID NO: 288 - RNA, 20 nt, artificial sequence
  Synthetic sequence; antisense nucleic acid molecule
ccgggauacuacuggcugag

SEQ ID NO: 289 - RNA, 20 nt, artificial sequence
  Synthetic sequence; antisense nucleic acid molecule
uccgggauacuacuggcuga

SEQ ID NO: 290 - RNA, 20 nt, artificial sequence
  Synthetic sequence; antisense nucleic acid molecule
auccgggauacuacuggcug

SEQ ID NO: 291 - RNA, 20 nt, artificial sequence
  Synthetic sequence; antisense nucleic acid molecule
ggugagauggaaagugaagc

SEQ ID NO: 292 - RNA, 20 nt, artificial sequence
  Synthetic sequence; antisense nucleic acid molecule
acuggugagauggaaaguga

SEQ ID NO: 293 - RNA, 20 nt, artificial sequence
  Synthetic sequence; antisense nucleic acid molecule
aacuggugagauggaaagug

SEQ ID NO: 294 - RNA, 20 nt, artificial sequence
  Synthetic sequence; antisense nucleic acid molecule
ccugaacuggugagauggaa

SEQ ID NO: 295 - RNA, 20 nt, artificial sequence
  Synthetic sequence; antisense nucleic acid molecule
agccugaacuggugagaugg

SEQ ID NO: 296 - RNA, 20 nt, artificial sequence
  Synthetic sequence; antisense nucleic acid molecule
gaagccugaacuggugagau

SEQ ID NO: 297 - RNA, 20 nt, artificial sequence
  Synthetic sequence; antisense nucleic acid molecule
ugaagccugaacuggugaga

SEQ ID NO: 298 - RNA, 20 nt, artificial sequence
  Synthetic sequence; antisense nucleic acid molecule
ugaugaugaagccugaacug

SEQ ID NO: 299 - RNA, 20 nt, artificial sequence
  Synthetic sequence; antisense nucleic acid molecule
caugaugaugaagccugaac

SEQ ID NO: 300 - RNA, 20 nt, artificial sequence
  Synthetic sequence; antisense nucleic acid molecule
acaugaugaugaagccugaa

SEQ ID NO: 301 - RNA, 20 nt, artificial sequence
  Synthetic sequence; antisense nucleic acid molecule
gacaugaugaugaagccuga

SEQ ID NO: 302 - RNA, 20 nt, artificial sequence
  Synthetic sequence; antisense nucleic acid molecule
gagacaugaugaugaagccu

SEQ ID NO: 303 - RNA, 20 nt, artificial sequence
  Synthetic sequence; antisense nucleic acid molecule
cacugccacugucuucagag

SEQ ID NO: 304 - RNA, 20 nt, artificial sequence
  Synthetic sequence; antisense nucleic acid molecule
gcgaucacugccacugucuu

SEQ ID NO: 305 - RNA, 20 nt, artificial sequence
  Synthetic sequence; antisense nucleic acid molecule
agggcgaucacugccacugu

SEQ ID NO: 306 - RNA, 20 nt, artificial sequence
  Synthetic sequence; antisense nucleic acid molecule
gugcgauuaggcuguuuccc

SEQ ID NO: 307 - RNA, 20 nt, artificial sequence
  Synthetic sequence; antisense nucleic acid molecule
cgugcgauuaggcuguuucc

SEQ ID NO: 308 - RNA, 20 nt, artificial sequence
  Synthetic sequence; antisense nucleic acid molecule
ccgugcgauuaggcuguuuc

SEQ ID NO: 309 - RNA, 20 nt, artificial sequence
  Synthetic sequence; antisense nucleic acid molecule
gccgugcgauuaggcuguuu

SEQ ID NO: 310 - RNA, 20 nt, artificial sequence
  Synthetic sequence; antisense nucleic acid molecule
ggccgugcgauuaggcuguu

SEQ ID NO: 311 - RNA, 20 nt, artificial sequence
  Synthetic sequence; antisense nucleic acid molecule
aggccgugcgauuaggcugu

SEQ ID NO: 312 - RNA, 20 nt, artificial sequence
  Synthetic sequence; antisense nucleic acid molecule
aaggaggccgugcgauuagg

SEQ ID NO: 313 - RNA, 20 nt, artificial sequence
  Synthetic sequence; antisense nucleic acid molecule
aaaggaggccgugcgauuag

SEQ ID NO: 314 - RNA, 20 nt, artificial sequence
  Synthetic sequence; antisense nucleic acid molecule
gaaaggaggccgugcgauua

SEQ ID NO: 315 - RNA, 20 nt, artificial sequence
  Synthetic sequence; antisense nucleic acid molecule
ggaaaggaggccgugcgauu

SEQ ID NO: 316 - RNA, 20 nt, artificial sequence
  Synthetic sequence; antisense nucleic acid molecule
agcagggugaggaguacggu

SEQ ID NO: 317 - RNA, 20 nt, artificial sequence
  Synthetic sequence; antisense nucleic acid molecule
aagcagggugaggaguacgg

SEQ ID NO: 318 - RNA, 20 nt, artificial sequence
  Synthetic sequence; antisense nucleic acid molecule
cagagaagcagggugaggag

SEQ ID NO: 319 - RNA, 20 nt, artificial sequence
  Synthetic sequence; antisense nucleic acid molecule
agggugaaacugguggccca

SEQ ID NO: 320 - RNA, 20 nt, artificial sequence
  Synthetic sequence; antisense nucleic acid molecule
aagggugaaacugguggccc

SEQ ID NO: 321 - RNA, 20 nt, artificial sequence
  Synthetic sequence; antisense nucleic acid molecule
gcaagggugaaacugguggc

SEQ ID NO: 322 - RNA, 20 nt, artificial sequence
  Synthetic sequence; antisense nucleic acid molecule
uggcaagggugaaacuggug

SEQ ID NO: 323 - RNA, 20 nt, artificial sequence
  Synthetic sequence; antisense nucleic acid molecule
uugguugggacucuugguau

SEQ ID NO: 324 - RNA, 20 nt, artificial sequence
  Synthetic sequence; antisense nucleic acid molecule
guugguugggacucuuggua

SEQ ID NO: 325 - RNA, 20 nt, artificial sequence
  Synthetic sequence; antisense nucleic acid molecule
caguugguugggacucuugg

SEQ ID NO: 326 - RNA, 20 nt, artificial sequence
  Synthetic sequence; antisense nucleic acid molecule
ugaccaguugguugggacuc

SEQ ID NO: 327 - RNA, 20 nt, artificial sequence
  Synthetic sequence; antisense nucleic acid molecule
ggugaccaguugguugggac

SEQ ID NO: 328 - RNA, 20 nt, artificial sequence
  Synthetic sequence; antisense nucleic acid molecule
gggugaccaguugguuggga

SEQ ID NO: 329 - RNA, 20 nt, artificial sequence
  Synthetic sequence; antisense nucleic acid molecule
uacgagcuggagucggcuug

SEQ ID NO: 330 - RNA, 20 nt, artificial sequence
  Synthetic sequence; antisense nucleic acid molecule
auacgagcuggagucggcuu

SEQ ID NO: 331 - RNA, 20 nt, artificial sequence
  Synthetic sequence; antisense nucleic acid molecule
gauacgagcuggagucggcu

SEQ ID NO: 332 - RNA, 20 nt, artificial sequence
  Synthetic sequence; antisense nucleic acid molecule
ugauacgagcuggagucggc

SEQ ID NO: 333 - RNA, 20 nt, artificial sequence
  Synthetic sequence; antisense nucleic acid molecule
cugauacgagcuggagucgg

SEQ ID NO: 334 - RNA, 20 nt, artificial sequence
  Synthetic sequence; antisense nucleic acid molecule
gcugauacgagcuggagucg

SEQ ID NO: 335 - RNA, 20 nt, artificial sequence
  Synthetic sequence; antisense nucleic acid molecule
ggcugauacgagcuggaguc

SEQ ID NO: 336 - RNA, 20 nt, artificial sequence
  Synthetic sequence; antisense nucleic acid molecule
uggcugauacgagcuggagu

SEQ ID NO: 337 - RNA, 20 nt, artificial sequence
  Synthetic sequence; antisense nucleic acid molecule
auggcugauacgagcuggag

SEQ ID NO: 338 - RNA, 20 nt, artificial sequence
  Synthetic sequence; antisense nucleic acid molecule
gauggcugauacgagcugga

SEQ ID NO: 339 - RNA, 20 nt, artificial sequence
  Synthetic sequence; antisense nucleic acid molecule
ugauggcugauacgagcugg

SEQ ID NO: 340 - RNA, 20 nt, artificial sequence
  Synthetic sequence; antisense nucleic acid molecule
uugauggcugauacgagcug

SEQ ID NO: 341 - RNA, 20 nt, artificial sequence
  Synthetic sequence; antisense nucleic acid molecule
guugauggcugauacgagcu

SEQ ID NO: 342 - RNA, 20 nt, artificial sequence
  Synthetic sequence; antisense nucleic acid molecule
gguugauggcugauacgagc

SEQ ID NO: 343 - RNA, 20 nt, artificial sequence
  Synthetic sequence; antisense nucleic acid molecule
agguugauggcugauacgag

SEQ ID NO: 344 - RNA, 20 nt, artificial sequence
  Synthetic sequence; antisense nucleic acid molecule
gagguugauggcugauacga

SEQ ID NO: 345 - RNA, 20 nt, artificial sequence
  Synthetic sequence; antisense nucleic acid molecule
agagguugauggcugauacg

SEQ ID NO: 346 - RNA, 20 nt, artificial sequence
  Synthetic sequence; antisense nucleic acid molecule
gagagguugauggcugauac

SEQ ID NO: 347 - RNA, 20 nt, artificial sequence
  Synthetic sequence; antisense nucleic acid molecule
ggagagguugauggcugaua

SEQ ID NO: 348 - RNA, 20 nt, artificial sequence
  Synthetic sequence; antisense nucleic acid molecule
uggagagguugauggcugau

SEQ ID NO: 349 - RNA, 20 nt, artificial sequence
  Synthetic sequence; antisense nucleic acid molecule
guggagagguugauggcuga

SEQ ID NO: 350 - RNA, 20 nt, artificial sequence
  Synthetic sequence; antisense nucleic acid molecule
uuggcaguggagagguugau

SEQ ID NO: 351 - RNA, 20 nt, artificial sequence
  Synthetic sequence; antisense nucleic acid molecule
ccuuggcaguggagagguug

SEQ ID NO: 352 - RNA, 20 nt, artificial sequence
  Synthetic sequence; antisense nucleic acid molecule
cuuuggaauccuuggcagug

SEQ ID NO: 353 - RNA, 20 nt, artificial sequence
  Synthetic sequence; antisense nucleic acid molecule
ggacugacagcacaaugauc

SEQ ID NO: 354 - RNA, 20 nt, artificial sequence
  Synthetic sequence; antisense nucleic acid molecule
aggacugacagcacaaugau

SEQ ID NO: 355 - RNA, 20 nt, artificial sequence
  Synthetic sequence; antisense nucleic acid molecule
caggacugacagcacaauga

SEQ ID NO: 356 - RNA, 20 nt, artificial sequence
  Synthetic sequence; antisense nucleic acid molecule
ccaggacugacagcacaaug

SEQ ID NO: 357 - RNA, 20 nt, artificial sequence
  Synthetic sequence; antisense nucleic acid molecule
accaggacugacagcacaau

SEQ ID NO: 358 - RNA, 20 nt, artificial sequence
  Synthetic sequence; antisense nucleic acid molecule
caccaggacugacagcacaa

SEQ ID NO: 359 - RNA, 20 nt, artificial sequence
  Synthetic sequence; antisense nucleic acid molecule
acaccaggacugacagcaca

SEQ ID NO: 360 - RNA, 20 nt, artificial sequence
  Synthetic sequence; antisense nucleic acid molecule
cacaccaggacugacagcac

SEQ ID NO: 361 - RNA, 20 nt, artificial sequence
  Synthetic sequence; antisense nucleic acid molecule
gcacaccaggacugacagca

SEQ ID NO: 362 - RNA, 20 nt, artificial sequence
  Synthetic sequence; antisense nucleic acid molecule
ggaagacagcacaccaggac

SEQ ID NO: 363 - RNA, 20 nt, artificial sequence
  Synthetic sequence; antisense nucleic acid molecule
uggaagacagcacaccagga

SEQ ID NO: 364 - RNA, 20 nt, artificial sequence
  Synthetic sequence; antisense nucleic acid molecule
caccuguaccaaggaaaucc

SEQ ID NO: 365 - RNA, 20 nt, artificial sequence
  Synthetic sequence; antisense nucleic acid molecule
agaaccaccuguaccaagga

SEQ ID NO: 366 - RNA, 20 nt, artificial sequence
  Synthetic sequence; antisense nucleic acid molecule
uaagguucaauccgaguguu

SEQ ID NO: 367 - RNA, 20 nt, artificial sequence
  Synthetic sequence; antisense nucleic acid molecule
guaagguucaauccgagugu

SEQ ID NO: 368 - RNA, 20 nt, artificial sequence
  Synthetic sequence; antisense nucleic acid molecule
aguaagguucaauccgagug

SEQ ID NO: 369 - RNA, 20 nt, artificial sequence
  Synthetic sequence; antisense nucleic acid molecule
uaguaagguucaauccgagu

SEQ ID NO: 370 - RNA, 20 nt, artificial sequence
  Synthetic sequence; antisense nucleic acid molecule
guaguaagguucaauccgag

SEQ ID NO: 371 - RNA, 20 nt, artificial sequence
  Synthetic sequence; antisense nucleic acid molecule
uguaguaagguucaauccga

SEQ ID NO: 372 - RNA, 20 nt, artificial sequence
  Synthetic sequence; antisense nucleic acid molecule
cuguaguaagguucaauccg

SEQ ID NO: 373 - RNA, 20 nt, artificial sequence
  Synthetic sequence; antisense nucleic acid molecule
gcuguaguaagguucaaucc

SEQ ID NO: 374 - RNA, 20 nt, artificial sequence
  Synthetic sequence; antisense nucleic acid molecule
ugcuguaguaagguucaauc

SEQ ID NO: 375 - RNA, 20 nt, artificial sequence
  Synthetic sequence; antisense nucleic acid molecule
gaugcuguaguaagguucaa

SEQ ID NO: 376 - RNA, 20 nt, artificial sequence
  Synthetic sequence; antisense nucleic acid molecule
agaugcuguaguaagguuca

SEQ ID NO: 377 - RNA, 20 nt, artificial sequence
  Synthetic sequence; antisense nucleic acid molecule
uagaugcuguaguaagguuc

SEQ ID NO: 378 - RNA, 20 nt, artificial sequence
  Synthetic sequence; antisense nucleic acid molecule
gcuguuauagaugcuguagu

SEQ ID NO: 379 - RNA, 20 nt, artificial sequence
  Synthetic sequence; antisense nucleic acid molecule
ugcuguuauagaugcuguag

SEQ ID NO: 380 - RNA, 20 nt, artificial sequence
  Synthetic sequence; antisense nucleic acid molecule
gcugcuguuauagaugcugu

SEQ ID NO: 381 - RNA, 20 nt, artificial sequence
  Synthetic sequence; antisense nucleic acid molecule
ggcugcuguuauagaugcug

SEQ ID NO: 382 - RNA, 20 nt, artificial sequence
  Synthetic sequence; antisense nucleic acid molecule
gggcugcuguuauagaugcu

SEQ ID NO: 383 - RNA, 20 nt, artificial sequence
  Synthetic sequence; antisense nucleic acid molecule
aagggcugcuguuauagaug

SEQ ID NO: 384 - RNA, 20 nt, artificial sequence
  Synthetic sequence; antisense nucleic acid molecule
ggaagggcugcuguuauaga

SEQ ID NO: 385 - RNA, 20 nt, artificial sequence
  Synthetic sequence; antisense nucleic acid molecule
uuacaugggcugcucuccuc

SEQ ID NO: 386 - RNA, 20 nt, artificial sequence
  Synthetic sequence; antisense nucleic acid molecule
guuacaugggcugcucuccu

SEQ ID NO: 387 - RNA, 20 nt, artificial sequence
  Synthetic sequence; antisense nucleic acid molecule
aguuacaugggcugcucucc

SEQ ID NO: 388 - RNA, 20 nt, artificial sequence
  Synthetic sequence; antisense nucleic acid molecule
caaaagaguuuacuggcugu

SEQ ID NO: 389 - RNA, 20 nt, artificial sequence
  Synthetic sequence; antisense nucleic acid molecule
auccaaaagaguuuacuggc

SEQ ID NO: 390 - RNA, 20 nt, artificial sequence
  Synthetic sequence; antisense nucleic acid molecule
cauauuccugcacuaaguca

SEQ ID NO: 391 - RNA, 20 nt, artificial sequence
  Synthetic sequence; antisense nucleic acid molecule
auccugaagacccuccugga

SEQ ID NO: 392 - RNA, 20 nt, artificial sequence
  Synthetic sequence; antisense nucleic acid molecule
augagauccugaagacccuc

SEQ ID NO: 393 - RNA, 20 nt, artificial sequence
  Synthetic sequence; antisense nucleic acid molecule
gaugagauccugaagacccu

SEQ ID NO: 394 - RNA, 20 nt, artificial sequence
  Synthetic sequence; antisense nucleic acid molecule
caggucaccaagguggcugu

SEQ ID NO: 395 - RNA, 20 nt, artificial sequence
  Synthetic sequence; antisense nucleic acid molecule
acaggucaccaagguggcug

SEQ ID NO: 396 - RNA, 20 nt, artificial sequence
  Synthetic sequence; antisense nucleic acid molecule
guacaggucaccaagguggc

SEQ ID NO: 397 - RNA, 20 nt, artificial sequence
  Synthetic sequence; antisense nucleic acid molecule
aguacaggucaccaaggugg

SEQ ID NO: 398 - RNA, 20 nt, artificial sequence
  Synthetic sequence; antisense nucleic acid molecule
aaguacaggucaccaaggug

SEQ ID NO: 399 - RNA, 20 nt, artificial sequence
  Synthetic sequence; antisense nucleic acid molecule
aaaguacaggucaccaaggu

SEQ ID NO: 400 - RNA, 20 nt, artificial sequence
  Synthetic sequence; antisense nucleic acid molecule
aaaaguacaggucaccaagg

SEQ ID NO: 401 - RNA, 20 nt, artificial sequence
  Synthetic sequence; antisense nucleic acid molecule
gaaaaguacaggucaccaag

SEQ ID NO: 402 - RNA, 20 nt, artificial sequence
  Synthetic sequence; antisense nucleic acid molecule
ccaguagaaaaguacagguc

SEQ ID NO: 403 - RNA, 20 nt, artificial sequence
  Synthetic sequence; antisense nucleic acid molecule
cgccaguagaaaaguacagg

SEQ ID NO: 404 - RNA, 20 nt, artificial sequence
  Synthetic sequence; antisense nucleic acid molecule
ccgccaguagaaaaguacag

SEQ ID NO: 405 - RNA, 20 nt, artificial sequence
  Synthetic sequence; antisense nucleic acid molecule
accgccaguagaaaaguaca

SEQ ID NO: 406 - RNA, 20 nt, artificial sequence
  Synthetic sequence; antisense nucleic acid molecule
gaccgccaguagaaaaguac

SEQ ID NO: 407 - RNA, 20 nt, artificial sequence
  Synthetic sequence; antisense nucleic acid molecule
ugaccgccaguagaaaagua

SEQ ID NO: 408 - RNA, 20 nt, artificial sequence
  Synthetic sequence; antisense nucleic acid molecule
augaccgccaguagaaaagu

SEQ ID NO: 409 - RNA, 20 nt, artificial sequence
  Synthetic sequence; antisense nucleic acid molecule
gaugaccgccaguagaaaag

SEQ ID NO: 410 - RNA, 20 nt, artificial sequence
  Synthetic sequence; antisense nucleic acid molecule
agaugaccgccaguagaaaa

SEQ ID NO: 411 - RNA, 20 nt, artificial sequence
  Synthetic sequence; antisense nucleic acid molecule
aagaugaccgccaguagaaa

SEQ ID NO: 412 - RNA, 20 nt, artificial sequence
  Synthetic sequence; antisense nucleic acid molecule
gaagaugaccgccaguagaa

SEQ ID NO: 413 - RNA, 20 nt, artificial sequence
  Synthetic sequence; antisense nucleic acid molecule
agaagaugaccgccaguaga

SEQ ID NO: 414 - RNA, 20 nt, artificial sequence
  Synthetic sequence; antisense nucleic acid molecule
cagaagaugaccgccaguag

SEQ ID NO: 415 - RNA, 20 nt, artificial sequence
  Synthetic sequence; antisense nucleic acid molecule
gcagaagaugaccgccagua

SEQ ID NO: 416 - RNA, 20 nt, artificial sequence
  Synthetic sequence; antisense nucleic acid molecule
ggcagaagaugaccgccagu

SEQ ID NO: 417 - RNA, 20 nt, artificial sequence
  Synthetic sequence; antisense nucleic acid molecule
aggcagaagaugaccgccag

SEQ ID NO: 418 - RNA, 20 nt, artificial sequence
  Synthetic sequence; antisense nucleic acid molecule
caggcagaagaugaccgcca

SEQ ID NO: 419 - RNA, 20 nt, artificial sequence
  Synthetic sequence; antisense nucleic acid molecule
acccaggcagaagaugaccg

SEQ ID NO: 420 - RNA, 20 nt, artificial sequence
  Synthetic sequence; antisense nucleic acid molecule
aggaacccaggcagaagaug

SEQ ID NO: 421 - RNA, 20 nt, artificial sequence
  Synthetic sequence; antisense nucleic acid molecule
guggcaagggugaaacuggu

SEQ ID NO: 422 - RNA, 20 nt, artificial sequence
  Synthetic sequence; antisense nucleic acid molecule
gguggcaagggugaaacugg

SEQ ID NO: 423 - RNA, 20 nt, artificial sequence
  Synthetic sequence; antisense nucleic acid molecule
agguggcaagggugaaacug

SEQ ID NO: 424 - RNA, 20 nt, artificial sequence
  Synthetic sequence; antisense nucleic acid molecule
aagguggcaagggugaaacu

SEQ ID NO: 425 - RNA, 20 nt, artificial sequence
  Synthetic sequence; antisense nucleic acid molecule
guuuucaagguagccaaggu

SEQ ID NO: 426 - RNA, 20 nt, artificial sequence
  Synthetic sequence; antisense nucleic acid molecule
gguuuucaagguagccaagg

SEQ ID NO: 427 - RNA, 20 nt, artificial sequence
  Synthetic sequence; antisense nucleic acid molecule
ugguuuucaagguagccaag

SEQ ID NO: 428 - RNA, 20 nt, artificial sequence
  Synthetic sequence; antisense nucleic acid molecule
cugguuuucaagguagccaa

SEQ ID NO: 429 - RNA, 20 nt, artificial sequence
  Synthetic sequence; antisense nucleic acid molecule
gugggacuugcugguuuuca

SEQ ID NO: 430 - RNA, 20 nt, artificial sequence
  Synthetic sequence; antisense nucleic acid molecule
cagaggugggacuugcuggu

SEQ ID NO: 431 - RNA, 20 nt, artificial sequence
  Synthetic sequence; antisense nucleic acid molecule
aagacagaggugggacuugc

SEQ ID NO: 432 - RNA, 20 nt, artificial sequence
  Synthetic sequence; antisense nucleic acid molecule
ggacaugggaagacagaggu

SEQ ID NO: 433 - RNA, 20 nt, artificial sequence
  Synthetic sequence; antisense nucleic acid molecule
uggacaugggaagacagagg

SEQ ID NO: 434 - RNA, 20 nt, artificial sequence
  Synthetic sequence; antisense nucleic acid molecule
ucagacuggacaugggaaga

SEQ ID NO: 435 - RNA, 20 nt, artificial sequence
  Synthetic sequence; antisense nucleic acid molecule
agcaaucagacuggacaugg

SEQ ID NO: 436 - RNA, 20 nt, artificial sequence
  Synthetic sequence; antisense nucleic acid molecule
cagcaaucagacuggacaug

SEQ ID NO: 437 - RNA, 20 nt, artificial sequence
  Synthetic sequence; antisense nucleic acid molecule
ccuuuuccagcaaucagacu

SEQ ID NO: 438 - RNA, 20 nt, artificial sequence
  Synthetic sequence; antisense nucleic acid molecule
ucccuuuuccagcaaucaga

SEQ ID NO: 439 - RNA, 20 nt, artificial sequence
  Synthetic sequence; antisense nucleic acid molecule
gcuuucccuuuuccagcaau

SEQ ID NO: 440 - RNA, 20 nt, artificial sequence
  Synthetic sequence; antisense nucleic acid molecule
aaauggcuuucccuuuucca

SEQ ID NO: 441 - RNA, 20 nt, artificial sequence
  Synthetic sequence; antisense nucleic acid molecule
gacaaaauggcuuucccuuu

SEQ ID NO: 442 - RNA, 20 nt, artificial sequence
  Synthetic sequence; antisense nucleic acid molecule
acauagagagacaaaauggc

SEQ ID NO: 443 - RNA, 20 nt, artificial sequence
  Synthetic sequence; antisense nucleic acid molecule
gaccacauagagagacaaaa

SEQ ID NO: 444 - RNA, 20 nt, artificial sequence
  Synthetic sequence; antisense nucleic acid molecule
cgaccacauagagagacaaa

SEQ ID NO: 445 - RNA, 20 nt, artificial sequence
  Synthetic sequence; antisense nucleic acid molecule
ucgaccacauagagagacaa

SEQ ID NO: 446 - RNA, 20 nt, artificial sequence
  Synthetic sequence; antisense nucleic acid molecule
caacacagaaggugaagucg

SEQ ID NO: 447 - RNA, 20 nt, artificial sequence
  Synthetic sequence; antisense nucleic acid molecule
gcaacacagaaggugaaguc

SEQ ID NO: 448 - RNA, 20 nt, artificial sequence
  Synthetic sequence; antisense nucleic acid molecule
agaccacagcaacacagaag

SEQ ID NO: 449 - RNA, 20 nt, artificial sequence
  Synthetic sequence; antisense nucleic acid molecule
gagaccacagcaacacagaa

SEQ ID NO: 450 - RNA, 20 nt, artificial sequence
  Synthetic sequence; antisense nucleic acid molecule
agagaccacagcaacacaga

SEQ ID NO: 451 - RNA, 20 nt, artificial sequence
  Synthetic sequence; antisense nucleic acid molecule
cagagaccacagcaacacag

SEQ ID NO: 452 - RNA, 20 nt, artificial sequence
  Synthetic sequence; antisense nucleic acid molecule
agagacagagaccacagcaa

SEQ ID NO: 453 - RNA, 20 nt, artificial sequence
  Synthetic sequence; antisense nucleic acid molecule
uaagagacagagaccacagc

SEQ ID NO: 454 - RNA, 20 nt, artificial sequence
  Synthetic sequence; antisense nucleic acid molecule
guaagagacagagaccacag

SEQ ID NO: 455 - RNA, 20 nt, artificial sequence
  Synthetic sequence; antisense nucleic acid molecule
uguaagagacagagaccaca

SEQ ID NO: 456 - RNA, 20 nt, artificial sequence
  Synthetic sequence; antisense nucleic acid molecule
caugauguaagagacagaga

SEQ ID NO: 457 - RNA, 20 nt, artificial sequence
  Synthetic sequence; antisense nucleic acid molecule
cgcagggucugagcaaucau

SEQ ID NO: 458 - RNA, 20 nt, artificial sequence
  Synthetic sequence; antisense nucleic acid molecule
ccgcagggucugagcaauca

SEQ ID NO: 459 - RNA, 20 nt, artificial sequence
  Synthetic sequence; antisense nucleic acid molecule
uccgcagggucugagcaauc

SEQ ID NO: 460 - RNA, 20 nt, artificial sequence
  Synthetic sequence; antisense nucleic acid molecule
uuccgcagggucugagcaau

SEQ ID NO: 461 - RNA, 20 nt, artificial sequence
  Synthetic sequence; antisense nucleic acid molecule
cuuccgcagggucugagcaa

SEQ ID NO: 462 - RNA, 20 nt, artificial sequence
  Synthetic sequence; antisense nucleic acid molecule
ucuuccgcagggucugagca

SEQ ID NO: 463 - RNA, 20 nt, artificial sequence
  Synthetic sequence; antisense nucleic acid molecule
uucuuccgcagggucugagc

SEQ ID NO: 464 - RNA, 20 nt, artificial sequence
  Synthetic sequence; antisense nucleic acid molecule
ggagagaaccaccuguacca

SEQ ID NO: 465 - RNA, 20 nt, artificial sequence
  Synthetic sequence; antisense nucleic acid molecule
uggagagaaccaccuguacc

SEQ ID NO: 466 - RNA, 20 nt, artificial sequence
  Synthetic sequence; antisense nucleic acid molecule
cuggagagaaccaccuguac

SEQ ID NO: 467 - RNA, 20 nt, artificial sequence
  Synthetic sequence; antisense nucleic acid molecule
gcuggagagaaccaccugua

SEQ ID NO: 468 - RNA, 20 nt, artificial sequence
  Synthetic sequence; antisense nucleic acid molecule
uugcuggagagaaccaccug

SEQ ID NO: 469 - RNA, 20 nt, artificial sequence
  Synthetic sequence; antisense nucleic acid molecule
auugcuggagagaaccaccu

SEQ ID NO: 470 - RNA, 20 nt, artificial sequence
  Synthetic sequence; antisense nucleic acid molecule
ccauugcuggagagaaccac

SEQ ID NO: 471 - RNA, 20 nt, artificial sequence
  Synthetic sequence; antisense nucleic acid molecule
ucccauugcuggagagaacc

SEQ ID NO: 472 - RNA, 20 nt, artificial sequence
  Synthetic sequence; antisense nucleic acid molecule
guaaagaaugaagcucccau

SEQ ID NO: 473 - RNA, 20 nt, artificial sequence
  Synthetic sequence; antisense nucleic acid molecule
gguaaagaaugaagcuccca

SEQ ID NO: 474 - RNA, 20 nt, artificial sequence
  Synthetic sequence; antisense nucleic acid molecule
aggguuuaauccugacuuga

SEQ ID NO: 475 - RNA, 20 nt, artificial sequence
  Synthetic sequence; antisense nucleic acid molecule
aaggguuuaauccugacuug

SEQ ID NO: 476 - RNA, 20 nt, artificial sequence
  Synthetic sequence; antisense nucleic acid molecule
ugcacuguuccgagaauaua

SEQ ID NO: 477 - RNA, 20 nt, artificial sequence
  Synthetic sequence; antisense nucleic acid molecule
cugcacuguuccgagaauau

SEQ ID NO: 478 - RNA, 20 nt, artificial sequence
  Synthetic sequence; antisense nucleic acid molecule
ccugcacuguuccgagaaua

SEQ ID NO: 479 - RNA, 20 nt, artificial sequence
  Synthetic sequence; antisense nucleic acid molecule
cccugcacuguuccgagaau

SEQ ID NO: 480 - RNA, 20 nt, artificial sequence
  Synthetic sequence; antisense nucleic acid molecule
gcccugcacuguuccgagaa

SEQ ID NO: 481 - RNA, 20 nt, artificial sequence
  Synthetic sequence; antisense nucleic acid molecule
agcccugcacuguuccgaga

SEQ ID NO: 482 - RNA, 20 nt, artificial sequence
  Synthetic sequence; antisense nucleic acid molecule
ucucagcccugcacuguucc

SEQ ID NO: 483 - RNA, 20 nt, artificial sequence
  Synthetic sequence; antisense nucleic acid molecule
uucucagcccugcacuguuc

SEQ ID NO: 484 - RNA, 20 nt, artificial sequence
  Synthetic sequence; antisense nucleic acid molecule
acuuuccuucucagcccugc

SEQ ID NO: 485 - RNA, 20 nt, artificial sequence
  Synthetic sequence; antisense nucleic acid molecule
gcaccagagcacuuuccuuc

SEQ ID NO: 486 - RNA, 20 nt, artificial sequence
  Synthetic sequence; antisense nucleic acid molecule
ggcaccagagcacuuuccuu

SEQ ID NO: 487 - RNA, 20 nt, artificial sequence
  Synthetic sequence; antisense nucleic acid molecule
aggcaccagagcacuuuccu

SEQ ID NO: 488 - RNA, 20 nt, artificial sequence
  Synthetic sequence; antisense nucleic acid molecule
gaggcaccagagcacuuucc

SEQ ID NO: 489 - RNA, 20 nt, artificial sequence
  Synthetic sequence; antisense nucleic acid molecule
auuggaggcaccagagcacu

SEQ ID NO: 490 - RNA, 20 nt, artificial sequence
  Synthetic sequence; antisense nucleic acid molecule
cuauguauuggaggcaccag

SEQ ID NO: 491 - RNA, 20 nt, artificial sequence
  Synthetic sequence; antisense nucleic acid molecule
ccuauguauuggaggcacca

SEQ ID NO: 492 - RNA, 20 nt, artificial sequence
  Synthetic sequence; antisense nucleic acid molecule
gucuuuuguuugcagcagaa

SEQ ID NO: 493 - RNA, 20 nt, artificial sequence
  Synthetic sequence; antisense nucleic acid molecule
agucuuuuguuugcagcaga

SEQ ID NO: 494 - RNA, 20 nt, artificial sequence
  Synthetic sequence; antisense nucleic acid molecule
ucgagucuuuuguuugcagc

SEQ ID NO: 495 - RNA, 20 nt, artificial sequence
  Synthetic sequence; antisense nucleic acid molecule
gucgagucuuuuguuugcag

SEQ ID NO: 496 - RNA, 20 nt, artificial sequence
  Synthetic sequence; antisense nucleic acid molecule
agucgagucuuuuguuugca

SEQ ID NO: 497 - RNA, 20 nt, artificial sequence
  Synthetic sequence; antisense nucleic acid molecule
aagucgagucuuuuguuugc

SEQ ID NO: 498 - RNA, 20 nt, artificial sequence
  Synthetic sequence; antisense nucleic acid molecule
gaagucgagucuuuuguuug

SEQ ID NO: 499 - RNA, 20 nt, artificial sequence
  Synthetic sequence; antisense nucleic acid molecule
cgaagucgagucuuuuguuu

SEQ ID NO: 500 - RNA, 20 nt, artificial sequence
  Synthetic sequence; antisense nucleic acid molecule
ucgaagucgagucuuuuguu

SEQ ID NO: 501 - RNA, 20 nt, artificial sequence
  Synthetic sequence; antisense nucleic acid molecule
ucgagguucccuuuucccau

SEQ ID NO: 502 - RNA, 20 nt, artificial sequence
  Synthetic sequence; antisense nucleic acid molecule
uucgagguucccuuuuccca

SEQ ID NO: 503 - RNA, 20 nt, artificial sequence
  Synthetic sequence; antisense nucleic acid molecule
cuucgagguucccuuuuccc

SEQ ID NO: 504 - RNA, 20 nt, artificial sequence
  Synthetic sequence; antisense nucleic acid molecule
acuucgagguucccuuuucc

SEQ ID NO: 505 - RNA, 20 nt, artificial sequence
  Synthetic sequence; antisense nucleic acid molecule
guugacuucgagguucccuu

SEQ ID NO: 506 - RNA, 20 nt, artificial sequence
  Synthetic sequence; antisense nucleic acid molecule
uguugacuucgagguucccu

SEQ ID NO: 507 - RNA, 20 nt, artificial sequence
  Synthetic sequence; antisense nucleic acid molecule
gucauauuccugcacuaagu

SEQ ID NO: 508 - RNA, 20 nt, artificial sequence
  Synthetic sequence; antisense nucleic acid molecule
ugucauauuccugcacuaag

SEQ ID NO: 509 - RNA, 20 nt, artificial sequence
  Synthetic sequence; antisense nucleic acid molecule
cugucauauuccugcacuaa

SEQ ID NO: 510 - RNA, 20 nt, artificial sequence
  Synthetic sequence; antisense nucleic acid molecule
gcugucauauuccugcacua

SEQ ID NO: 511 - RNA, 20 nt, artificial sequence
  Synthetic sequence; antisense nucleic acid molecule
agugcugucauauuccugca

SEQ ID NO: 512 - RNA, 20 nt, artificial sequence
  Synthetic sequence; antisense nucleic acid molecule
aagugcugucauauuccugc

SEQ ID NO: 513 - RNA, 20 nt, artificial sequence
  Synthetic sequence; antisense nucleic acid molecule
ugaagugcugucauauuccu

SEQ ID NO: 514 - RNA, 20 nt, artificial sequence
  Synthetic sequence; antisense nucleic acid molecule
cugaagugcugucauauucc

SEQ ID NO: 515 - RNA, 20 nt, artificial sequence
  Synthetic sequence; antisense nucleic acid molecule
uggaaucugcuuggcugaag

SEQ ID NO: 516 - RNA, 20 nt, artificial sequence
  Synthetic sequence; antisense nucleic acid molecule
acuggaaucugcuuggcuga

SEQ ID NO: 517 - RNA, 20 nt, artificial sequence
  Synthetic sequence; antisense nucleic acid molecule
cgccacugaucucaaguuag

SEQ ID NO: 518 - RNA, 20 nt, artificial sequence
  Synthetic sequence; antisense nucleic acid molecule
auccgccacugaucucaagu

SEQ ID NO: 519 - RNA, 20 nt, artificial sequence
  Synthetic sequence; antisense nucleic acid molecule
gguuuugauccgccacugau

SEQ ID NO: 520 - RNA, 20 nt, artificial sequence
  Synthetic sequence; antisense nucleic acid molecule
agguuuugauccgccacuga

SEQ ID NO: 521 - RNA, 20 nt, artificial sequence
  Synthetic sequence; antisense nucleic acid molecule
uagguuuugauccgccacug

SEQ ID NO: 522 - RNA, 20 nt, artificial sequence
  Synthetic sequence; antisense nucleic acid molecule
guagguuuugauccgccacu

SEQ ID NO: 523 - RNA, 20 nt, artificial sequence
  Synthetic sequence; antisense nucleic acid molecule
uguagguuuugauccgccac

SEQ ID NO: 524 - RNA, 20 nt, artificial sequence
  Synthetic sequence; antisense nucleic acid molecule
uuguagguuuugauccgcca

SEQ ID NO: 525 - RNA, 20 nt, artificial sequence
  Synthetic sequence; antisense nucleic acid molecule
cuuguagguuuugauccgcc

SEQ ID NO: 526 - RNA, 20 nt, artificial sequence
  Synthetic sequence; antisense nucleic acid molecule
ucuuguagguuuugauccgc

SEQ ID NO: 527 - RNA, 20 nt, artificial sequence
  Synthetic sequence; antisense nucleic acid molecule
aucuuguagguuuugauccg

SEQ ID NO: 528 - RNA, 20 nt, artificial sequence
  Synthetic sequence; antisense nucleic acid molecule
ccauaacugccaacuuuuca

SEQ ID NO: 529 - RNA, 20 nt, artificial sequence
  Synthetic sequence; antisense nucleic acid molecule
accauaacugccaacuuuuc

SEQ ID NO: 530 - RNA, 19 nt, artificial sequence
  Synthetic sequence; sense nucleic acid molecule
cgguggcgauggcgaugau

SEQ ID NO: 531 - RNA, 19 nt, artificial sequence
  Synthetic sequence; antisense nucleic acid molecule
aucaucgccaucgccaccg

SEQ ID NO: 532 - RNA, 19 nt, artificial sequence
  Synthetic sequence; sense nucleic acid molecule
gguggcgauggcgaugaug

SEQ ID NO: 533 - RNA, 19 nt, artificial sequence
  Synthetic sequence; antisense nucleic acid molecule
caucaucgccaucgccacc

SEQ ID NO: 534 - RNA, 19 nt, artificial sequence
  Synthetic sequence; sense nucleic acid molecule
guggcgauggcgaugaugc

SEQ ID NO: 535 - RNA, 19 nt, artificial sequence
  Synthetic sequence; antisense nucleic acid molecule
gcaucaucgccaucgccac

SEQ ID NO: 536 - RNA, 19 nt, artificial sequence
  Synthetic sequence; sense nucleic acid molecule
uggcgauggcgaugaugcc

SEQ ID NO: 537 - RNA, 19 nt, artificial sequence
  Synthetic sequence; antisense nucleic acid molecule
ggcaucaucgccaucgcca

SEQ ID NO: 538 - RNA, 19 nt, artificial sequence
  Synthetic sequence; sense nucleic acid molecule
ggcgauggcgaugaugccu

SEQ ID NO: 539 - RNA, 19 nt, artificial sequence
  Synthetic sequence; antisense nucleic acid molecule
aggcaucaucgccaucgcc

SEQ ID NO: 540 - RNA, 19 nt, artificial sequence
  Synthetic sequence; sense nucleic acid molecule
cgaugaugccucuaguccu

SEQ ID NO: 541 - RNA, 19 nt, artificial sequence
  Synthetic sequence; antisense nucleic acid molecule
aggacuagaggcaucaucg

SEQ ID NO: 542 - RNA, 19 nt, artificial sequence
  Synthetic sequence; sense nucleic acid molecule
gaugaugccucuaguccug

SEQ ID NO: 543 - RNA, 19 nt, artificial sequence
  Synthetic sequence; antisense nucleic acid molecule
caggacuagaggcaucauc

SEQ ID NO: 544 - RNA, 19 nt, artificial sequence
  Synthetic sequence; sense nucleic acid molecule
augaugccucuaguccugc

SEQ ID NO: 545 - RNA, 19 nt, artificial sequence
  Synthetic sequence; antisense nucleic acid molecule
gcaggacuagaggcaucau

SEQ ID NO: 546 - RNA, 19 nt, artificial sequence
  Synthetic sequence; sense nucleic acid molecule
ugaugccucuaguccugca

SEQ ID NO: 547 - RNA, 19 nt, artificial sequence
  Synthetic sequence; antisense nucleic acid molecule
ugcaggacuagaggcauca

SEQ ID NO: 548 - RNA, 19 nt, artificial sequence
  Synthetic sequence; sense nucleic acid molecule
gccucuaguccugcaucau

SEQ ID NO: 549 - RNA, 19 nt, artificial sequence
  Synthetic sequence; antisense nucleic acid molecule
augaugcaggacuagaggc

SEQ ID NO: 550 - RNA, 19 nt, artificial sequence
  Synthetic sequence; sense nucleic acid molecule
ccucuaguccugcaucauc

SEQ ID NO: 551 - RNA, 19 nt, artificial sequence
  Synthetic sequence; antisense nucleic acid molecule
gaugaugcaggacuagagg

SEQ ID NO: 552 - RNA, 19 nt, artificial sequence
  Synthetic sequence; sense nucleic acid molecule
cucuaguccugcaucaucc

SEQ ID NO: 553 - RNA, 19 nt, artificial sequence
  Synthetic sequence; antisense nucleic acid molecule
ggaugaugcaggacuagag

SEQ ID NO: 554 - RNA, 19 nt, artificial sequence
  Synthetic sequence; sense nucleic acid molecule
ucuaguccugcaucaucca

SEQ ID NO: 555 - RNA, 19 nt, artificial sequence
  Synthetic sequence; antisense nucleic acid molecule
uggaugaugcaggacuaga

SEQ ID NO: 556 - RNA, 19 nt, artificial sequence
  Synthetic sequence; sense nucleic acid molecule
cuaguccugcaucauccag

SEQ ID NO: 557 - RNA, 19 nt, artificial sequence
  Synthetic sequence; antisense nucleic acid molecule
cuggaugaugcaggacuag

SEQ ID NO: 558 - RNA, 19 nt, artificial sequence
  Synthetic sequence; sense nucleic acid molecule
uaguccugcaucauccaga

SEQ ID NO: 559 - RNA, 19 nt, artificial sequence
  Synthetic sequence; antisense nucleic acid molecule
ucuggaugaugcaggacua

SEQ ID NO: 560 - RNA, 19 nt, artificial sequence
  Synthetic sequence; sense nucleic acid molecule
ccugcaucauccagagcgg

SEQ ID NO: 561 - RNA, 19 nt, artificial sequence
  Synthetic sequence; antisense nucleic acid molecule
ccgcucuggaugaugcagg

SEQ ID NO: 562 - RNA, 19 nt, artificial sequence
  Synthetic sequence; sense nucleic acid molecule
cugcaucauccagagcggc

SEQ ID NO: 563 - RNA, 19 nt, artificial sequence
  Synthetic sequence; antisense nucleic acid molecule
gccgcucuggaugaugcag

SEQ ID NO: 564 - RNA, 19 nt, artificial sequence
  Synthetic sequence; sense nucleic acid molecule
ugcaucauccagagcggca

SEQ ID NO: 565 - RNA, 19 nt, artificial sequence
  Synthetic sequence; antisense nucleic acid molecule
ugccgcucuggaugaugca

SEQ ID NO: 566 - RNA, 19 nt, artificial sequence
  Synthetic sequence; sense nucleic acid molecule
gcaucauccagagcggcag

SEQ ID NO: 567 - RNA, 19 nt, artificial sequence
  Synthetic sequence; antisense nucleic acid molecule
cugccgcucuggaugaugc

SEQ ID NO: 568 - RNA, 19 nt, artificial sequence
  Synthetic sequence; sense nucleic acid molecule
caucauccagagcggcagg

SEQ ID NO: 569 - RNA, 19 nt, artificial sequence
  Synthetic sequence; antisense nucleic acid molecule
ccugccgcucuggaugaug

SEQ ID NO: 570 - RNA, 19 nt, artificial sequence
  Synthetic sequence; sense nucleic acid molecule
aucauccagagcggcaggc

SEQ ID NO: 571 - RNA, 19 nt, artificial sequence
  Synthetic sequence; antisense nucleic acid molecule
gccugccgcucuggaugau

SEQ ID NO: 572 - RNA, 19 nt, artificial sequence
  Synthetic sequence; sense nucleic acid molecule
ccggcaggcuuaucugucu

SEQ ID NO: 573 - RNA, 19 nt, artificial sequence
  Synthetic sequence; antisense nucleic acid molecule
agacagauaagccugccgg

SEQ ID NO: 574 - RNA, 19 nt, artificial sequence
  Synthetic sequence; sense nucleic acid molecule
cggcaggcuuaucugucuu

SEQ ID NO: 575 - RNA, 19 nt, artificial sequence
  Synthetic sequence; antisense nucleic acid molecule
aagacagauaagccugccg

SEQ ID NO: 576 - RNA, 19 nt, artificial sequence
  Synthetic sequence; sense nucleic acid molecule
ggcaggcuuaucugucuug

SEQ ID NO: 577 - RNA, 19 nt, artificial sequence
  Synthetic sequence; antisense nucleic acid molecule
caagacagauaagccugcc

SEQ ID NO: 578 - RNA, 19 nt, artificial sequence
  Synthetic sequence; sense nucleic acid molecule
gcaggcuuaucugucuugg

SEQ ID NO: 579 - RNA, 19 nt, artificial sequence
  Synthetic sequence; antisense nucleic acid molecule
ccaagacagauaagccugc

SEQ ID NO: 580 - RNA, 19 nt, artificial sequence
  Synthetic sequence; sense nucleic acid molecule
aggcuuaucugucuugggc

SEQ ID NO: 581 - RNA, 19 nt, artificial sequence
  Synthetic sequence; antisense nucleic acid molecule
gcccaagacagauaagccu

SEQ ID NO: 582 - RNA, 19 nt, artificial sequence
  Synthetic sequence; sense nucleic acid molecule
ggcuuaucugucuugggcc

SEQ ID NO: 583 - RNA, 19 nt, artificial sequence
  Synthetic sequence; antisense nucleic acid molecule
ggcccaagacagauaagcc

SEQ ID NO: 584 - RNA, 19 nt, artificial sequence
  Synthetic sequence; sense nucleic acid molecule
gcuuaucugucuugggccu

SEQ ID NO: 585 - RNA, 19 nt, artificial sequence
  Synthetic sequence; antisense nucleic acid molecule
aggcccaagacagauaagc

SEQ ID NO: 586 - RNA, 19 nt, artificial sequence
  Synthetic sequence; sense nucleic acid molecule
cuuaucugucuugggccuc

SEQ ID NO: 587 - RNA, 19 nt, artificial sequence
  Synthetic sequence; antisense nucleic acid molecule
gaggcccaagacagauaag

SEQ ID NO: 588 - RNA, 19 nt, artificial sequence
  Synthetic sequence; sense nucleic acid molecule
uuaucugucuugggccucu

SEQ ID NO: 589 - RNA, 19 nt, artificial sequence
  Synthetic sequence; antisense nucleic acid molecule
agaggcccaagacagauaa

SEQ ID NO: 590 - RNA, 19 nt, artificial sequence
  Synthetic sequence; sense nucleic acid molecule
gucuugggccucuuuuguc

SEQ ID NO: 591 - RNA, 19 nt, artificial sequence
  Synthetic sequence; antisense nucleic acid molecule
gacaaaagaggcccaagac

SEQ ID NO: 592 - RNA, 19 nt, artificial sequence
  Synthetic sequence; sense nucleic acid molecule
gggccucuuuugucacaua

SEQ ID NO: 593 - RNA, 19 nt, artificial sequence
  Synthetic sequence; antisense nucleic acid molecule
uaugugacaaaagaggccc

SEQ ID NO: 594 - RNA, 19 nt, artificial sequence
  Synthetic sequence; sense nucleic acid molecule
ggccucuuuugucacauau

SEQ ID NO: 595 - RNA, 19 nt, artificial sequence
  Synthetic sequence; antisense nucleic acid molecule
auaugugacaaaagaggcc

SEQ ID NO: 596 - RNA, 19 nt, artificial sequence
  Synthetic sequence; sense nucleic acid molecule
gccucuuuugucacauauu

SEQ ID NO: 597 - RNA, 19 nt, artificial sequence
  Synthetic sequence; antisense nucleic acid molecule
aauaugugacaaaagaggc

SEQ ID NO: 598 - RNA, 19 nt, artificial sequence
  Synthetic sequence; sense nucleic acid molecule
cuuuugucacauauugcuc

SEQ ID NO: 599 - RNA, 19 nt, artificial sequence
  Synthetic sequence; antisense nucleic acid molecule
gagcaauaugugacaaaag

SEQ ID NO: 600 - RNA, 19 nt, artificial sequence
  Synthetic sequence; sense nucleic acid molecule
uuuugucacauauugcuca

SEQ ID NO: 601 - RNA, 19 nt, artificial sequence
  Synthetic sequence; antisense nucleic acid molecule
ugagcaauaugugacaaaa

SEQ ID NO: 602 - RNA, 19 nt, artificial sequence
  Synthetic sequence; sense nucleic acid molecule
uuugucacauauugcucau

SEQ ID NO: 603 - RNA, 19 nt, artificial sequence
  Synthetic sequence; antisense nucleic acid molecule
augagcaauaugugacaaa

SEQ ID NO: 604 - RNA, 19 nt, artificial sequence
  Synthetic sequence; sense nucleic acid molecule
uugucacauauugcucauc

SEQ ID NO: 605 - RNA, 19 nt, artificial sequence
  Synthetic sequence; antisense nucleic acid molecule
gaugagcaauaugugacaa

SEQ ID NO: 606 - RNA, 19 nt, artificial sequence
  Synthetic sequence; sense nucleic acid molecule
gucacauauugcucaucug

SEQ ID NO: 607 - RNA, 19 nt, artificial sequence
  Synthetic sequence; antisense nucleic acid molecule
cagaugagcaauaugugac

SEQ ID NO: 608 - RNA, 19 nt, artificial sequence
  Synthetic sequence; sense nucleic acid molecule
ucacauauugcucaucugu

SEQ ID NO: 609 - RNA, 19 nt, artificial sequence
  Synthetic sequence; antisense nucleic acid molecule
acagaugagcaauauguga

SEQ ID NO: 610 - RNA, 19 nt, artificial sequence
  Synthetic sequence; sense nucleic acid molecule
ucaucugugagcugaggcc

SEQ ID NO: 611 - RNA, 19 nt, artificial sequence
  Synthetic sequence; antisense nucleic acid molecule
ggccucagcucacagauga

SEQ ID NO: 612 - RNA, 19 nt, artificial sequence
  Synthetic sequence; sense nucleic acid molecule
caucugugagcugaggccc

SEQ ID NO: 613 - RNA, 19 nt, artificial sequence
  Synthetic sequence; antisense nucleic acid molecule
gggccucagcucacagaug

SEQ ID NO: 614 - RNA, 19 nt, artificial sequence
  Synthetic sequence; sense nucleic acid molecule
aucugugagcugaggcccu

SEQ ID NO: 615 - RNA, 19 nt, artificial sequence
  Synthetic sequence; antisense nucleic acid molecule
agggccucagcucacagau

SEQ ID NO: 616 - RNA, 19 nt, artificial sequence
  Synthetic sequence; sense nucleic acid molecule
cugugagcugaggcccuga

SEQ ID NO: 617 - RNA, 19 nt, artificial sequence
  Synthetic sequence; antisense nucleic acid molecule
ucagggccucagcucacag

SEQ ID NO: 618 - RNA, 19 nt, artificial sequence
  Synthetic sequence; sense nucleic acid molecule
gugagcugaggcccugacu

SEQ ID NO: 619 - RNA, 19 nt, artificial sequence
  Synthetic sequence; antisense nucleic acid molecule
agucagggccucagcucac

SEQ ID NO: 620 - RNA, 19 nt, artificial sequence
  Synthetic sequence; sense nucleic acid molecule
gaggcccugacucacugag

SEQ ID NO: 621 - RNA, 19 nt, artificial sequence
  Synthetic sequence; antisense nucleic acid molecule
cucagugagucagggccuc

SEQ ID NO: 622 - RNA, 19 nt, artificial sequence
  Synthetic sequence; sense nucleic acid molecule
ccaaugccaccucgcucca

SEQ ID NO: 623 - RNA, 19 nt, artificial sequence
  Synthetic sequence; antisense nucleic acid molecule
uggagcgagguggcauugg

SEQ ID NO: 624 - RNA, 19 nt, artificial sequence
  Synthetic sequence; sense nucleic acid molecule
caccucgcuccaugugccu

SEQ ID NO: 625 - RNA, 19 nt, artificial sequence
  Synthetic sequence; antisense nucleic acid molecule
aggcacauggagcgaggug

SEQ ID NO: 626 - RNA, 19 nt, artificial sequence
  Synthetic sequence; sense nucleic acid molecule
ucgcuccaugugccucacu

SEQ ID NO: 627 - RNA, 19 nt, artificial sequence
  Synthetic sequence; antisense nucleic acid molecule
agugaggcacauggagcga

SEQ ID NO: 628 - RNA, 19 nt, artificial sequence
  Synthetic sequence; sense nucleic acid molecule
cgcuccaugugccucacuc

SEQ ID NO: 629 - RNA, 19 nt, artificial sequence
  Synthetic sequence; antisense nucleic acid molecule
gagugaggcacauggagcg

SEQ ID NO: 630 - RNA, 19 nt, artificial sequence
  Synthetic sequence; sense nucleic acid molecule
gugccucacucacaggaag

SEQ ID NO: 631 - RNA, 19 nt, artificial sequence
  Synthetic sequence; antisense nucleic acid molecule
cuuccugugagugaggcac

SEQ ID NO: 632 - RNA, 19 nt, artificial sequence
  Synthetic sequence; sense nucleic acid molecule
ugccucacucacaggaagg

SEQ ID NO: 633 - RNA, 19 nt, artificial sequence
  Synthetic sequence; antisense nucleic acid molecule
ccuuccugugagugaggca

SEQ ID NO: 634 - RNA, 19 nt, artificial sequence
  Synthetic sequence; sense nucleic acid molecule
gccucacucacaggaagga

SEQ ID NO: 635 - RNA, 19 nt, artificial sequence
  Synthetic sequence; antisense nucleic acid molecule
uccuuccugugagugaggc

SEQ ID NO: 636 - RNA, 19 nt, artificial sequence
  Synthetic sequence; sense nucleic acid molecule
ccucacucacaggaaggaa

SEQ ID NO: 637 - RNA, 19 nt, artificial sequence
  Synthetic sequence; antisense nucleic acid molecule
uuccuuccugugagugagg

SEQ ID NO: 638 - RNA, 19 nt, artificial sequence
  Synthetic sequence; sense nucleic acid molecule
ucucuccaggagggucuuc

SEQ ID NO: 639 - RNA, 19 nt, artificial sequence
  Synthetic sequence; antisense nucleic acid molecule
gaagacccuccuggagaga

SEQ ID NO: 640 - RNA, 19 nt, artificial sequence
  Synthetic sequence; sense nucleic acid molecule
aggagggucuucaggaucu

SEQ ID NO: 641 - RNA, 19 nt, artificial sequence
  Synthetic sequence; antisense nucleic acid molecule
agauccugaagacccuccu

SEQ ID NO: 642 - RNA, 19 nt, artificial sequence
  Synthetic sequence; sense nucleic acid molecule
agggucuucaggaucucau

SEQ ID NO: 643 - RNA, 19 nt, artificial sequence
  Synthetic sequence; antisense nucleic acid molecule
augagauccugaagacccu

SEQ ID NO: 644 - RNA, 19 nt, artificial sequence
  Synthetic sequence; sense nucleic acid molecule
gggucuucaggaucucauc

SEQ ID NO: 645 - RNA, 19 nt, artificial sequence
  Synthetic sequence; antisense nucleic acid molecule
gaugagauccugaagaccc

SEQ ID NO: 646 - RNA, 19 nt, artificial sequence
  Synthetic sequence; sense nucleic acid molecule
cacagccaccuuggugacc

SEQ ID NO: 647 - RNA, 19 nt, artificial sequence
  Synthetic sequence; antisense nucleic acid molecule
ggucaccaagguggcugug

SEQ ID NO: 648 - RNA, 19 nt, artificial sequence
  Synthetic sequence; sense nucleic acid molecule
gccaccuuggugaccugua

SEQ ID NO: 649 - RNA, 19 nt, artificial sequence
  Synthetic sequence; antisense nucleic acid molecule
uacaggucaccaagguggc

SEQ ID NO: 650 - RNA, 19 nt, artificial sequence
  Synthetic sequence; sense nucleic acid molecule
ccaccuuggugaccuguac

SEQ ID NO: 651 - RNA, 19 nt, artificial sequence
  Synthetic sequence; antisense nucleic acid molecule
guacaggucaccaaggugg

SEQ ID NO: 652 - RNA, 19 nt, artificial sequence
  Synthetic sequence; sense nucleic acid molecule
caccuuggugaccuguacu

SEQ ID NO: 653 - RNA, 19 nt, artificial sequence
  Synthetic sequence; antisense nucleic acid molecule
aguacaggucaccaaggug

SEQ ID NO: 654 - RNA, 19 nt, artificial sequence
  Synthetic sequence; sense nucleic acid molecule
accuuggugaccuguacuu

SEQ ID NO: 655 - RNA, 19 nt, artificial sequence
  Synthetic sequence; antisense nucleic acid molecule
aaguacaggucaccaaggu

SEQ ID NO: 656 - RNA, 19 nt, artificial sequence
  Synthetic sequence; sense nucleic acid molecule
ccuuggugaccuguacuuu

SEQ ID NO: 657 - RNA, 19 nt, artificial sequence
  Synthetic sequence; antisense nucleic acid molecule
aaaguacaggucaccaagg

SEQ ID NO: 658 - RNA, 19 nt, artificial sequence
  Synthetic sequence; sense nucleic acid molecule
cuuggugaccuguacuuuu

SEQ ID NO: 659 - RNA, 19 nt, artificial sequence
  Synthetic sequence; antisense nucleic acid molecule
aaaaguacaggucaccaag

SEQ ID NO: 660 - RNA, 19 nt, artificial sequence
  Synthetic sequence; sense nucleic acid molecule
ggugaccuguacuuuucua

SEQ ID NO: 661 - RNA, 19 nt, artificial sequence
  Synthetic sequence; antisense nucleic acid molecule
uagaaaaguacaggucacc

SEQ ID NO: 662 - RNA, 19 nt, artificial sequence
  Synthetic sequence; sense nucleic acid molecule
gugaccuguacuuuucuac

SEQ ID NO: 663 - RNA, 19 nt, artificial sequence
  Synthetic sequence; antisense nucleic acid molecule
guagaaaaguacaggucac

SEQ ID NO: 664 - RNA, 19 nt, artificial sequence
  Synthetic sequence; sense nucleic acid molecule
cuguacuuuucuacuggcg

SEQ ID NO: 665 - RNA, 19 nt, artificial sequence
  Synthetic sequence; antisense nucleic acid molecule
cgccaguagaaaaguacag

SEQ ID NO: 666 - RNA, 19 nt, artificial sequence
  Synthetic sequence; sense nucleic acid molecule
uguacuuuucuacuggcgg

SEQ ID NO: 667 - RNA, 19 nt, artificial sequence
  Synthetic sequence; antisense nucleic acid molecule
ccgccaguagaaaaguaca

SEQ ID NO: 668 - RNA, 19 nt, artificial sequence
  Synthetic sequence; sense nucleic acid molecule
guacuuuucuacuggcggu

SEQ ID NO: 669 - RNA, 19 nt, artificial sequence
  Synthetic sequence; antisense nucleic acid molecule
accgccaguagaaaaguac

SEQ ID NO: 670 - RNA, 19 nt, artificial sequence
  Synthetic sequence; sense nucleic acid molecule
uacuuuucuacuggcgguc

SEQ ID NO: 671 - RNA, 19 nt, artificial sequence
  Synthetic sequence; antisense nucleic acid molecule
gaccgccaguagaaaagua

SEQ ID NO: 672 - RNA, 19 nt, artificial sequence
  Synthetic sequence; sense nucleic acid molecule
acuuuucuacuggcgguca

SEQ ID NO: 673 - RNA, 19 nt, artificial sequence
  Synthetic sequence; antisense nucleic acid molecule
ugaccgccaguagaaaagu

SEQ ID NO: 674 - RNA, 19 nt, artificial sequence
  Synthetic sequence; sense nucleic acid molecule
cuuuucuacuggcggucau

SEQ ID NO: 675 - RNA, 19 nt, artificial sequence
  Synthetic sequence; antisense nucleic acid molecule
augaccgccaguagaaaag

SEQ ID NO: 676 - RNA, 19 nt, artificial sequence
  Synthetic sequence; sense nucleic acid molecule
uuuucuacuggcggucauc

SEQ ID NO: 677 - RNA, 19 nt, artificial sequence
  Synthetic sequence; antisense nucleic acid molecule
gaugaccgccaguagaaaa

SEQ ID NO: 678 - RNA, 19 nt, artificial sequence
  Synthetic sequence; sense nucleic acid molecule
uuucuacuggcggucaucu

SEQ ID NO: 679 - RNA, 19 nt, artificial sequence
  Synthetic sequence; antisense nucleic acid molecule
agaugaccgccaguagaaa

SEQ ID NO: 680 - RNA, 19 nt, artificial sequence
  Synthetic sequence; sense nucleic acid molecule
uucuacuggcggucaucuu

SEQ ID NO: 681 - RNA, 19 nt, artificial sequence
  Synthetic sequence; antisense nucleic acid molecule
aagaugaccgccaguagaa

SEQ ID NO: 682 - RNA, 19 nt, artificial sequence
  Synthetic sequence; sense nucleic acid molecule
ucuacuggcggucaucuuc

SEQ ID NO: 683 - RNA, 19 nt, artificial sequence
  Synthetic sequence; antisense nucleic acid molecule
gaagaugaccgccaguaga

SEQ ID NO: 684 - RNA, 19 nt, artificial sequence
  Synthetic sequence; sense nucleic acid molecule
cuacuggcggucaucuucu

SEQ ID NO: 685 - RNA, 19 nt, artificial sequence
  Synthetic sequence; antisense nucleic acid molecule
agaagaugaccgccaguag

SEQ ID NO: 686 - RNA, 19 nt, artificial sequence
  Synthetic sequence; sense nucleic acid molecule
uacuggcggucaucuucug

SEQ ID NO: 687 - RNA, 19 nt, artificial sequence
  Synthetic sequence; antisense nucleic acid molecule
cagaagaugaccgccagua

SEQ ID NO: 688 - RNA, 19 nt, artificial sequence
  Synthetic sequence; sense nucleic acid molecule
acuggcggucaucuucugc

SEQ ID NO: 689 - RNA, 19 nt, artificial sequence
  Synthetic sequence; antisense nucleic acid molecule
gcagaagaugaccgccagu

SEQ ID NO: 690 - RNA, 19 nt, artificial sequence
  Synthetic sequence; sense nucleic acid molecule
cuggcggucaucuucugcc

SEQ ID NO: 691 - RNA, 19 nt, artificial sequence
  Synthetic sequence; antisense nucleic acid molecule
ggcagaagaugaccgccag

SEQ ID NO: 692 - RNA, 19 nt, artificial sequence
  Synthetic sequence; sense nucleic acid molecule
uggcggucaucuucugccu

SEQ ID NO: 693 - RNA, 19 nt, artificial sequence
  Synthetic sequence; antisense nucleic acid molecule
aggcagaagaugaccgcca

SEQ ID NO: 694 - RNA, 19 nt, artificial sequence
  Synthetic sequence; sense nucleic acid molecule
ggcggucaucuucugccug

SEQ ID NO: 695 - RNA, 19 nt, artificial sequence
  Synthetic sequence; antisense nucleic acid molecule
caggcagaagaugaccgcc

SEQ ID NO: 696 - RNA, 19 nt, artificial sequence
  Synthetic sequence; sense nucleic acid molecule
gcggucaucuucugccugg

SEQ ID NO: 697 - RNA, 19 nt, artificial sequence
  Synthetic sequence; antisense nucleic acid molecule
ccaggcagaagaugaccgc

SEQ ID NO: 698 - RNA, 19 nt, artificial sequence
  Synthetic sequence; sense nucleic acid molecule
cggucaucuucugccuggg

SEQ ID NO: 699 - RNA, 19 nt, artificial sequence
  Synthetic sequence; antisense nucleic acid molecule
cccaggcagaagaugaccg

SEQ ID NO: 700 - RNA, 19 nt, artificial sequence
  Synthetic sequence; sense nucleic acid molecule
ggucaucuucugccugggu

SEQ ID NO: 701 - RNA, 19 nt, artificial sequence
  Synthetic sequence; antisense nucleic acid molecule
acccaggcagaagaugacc

SEQ ID NO: 702 - RNA, 19 nt, artificial sequence
  Synthetic sequence; sense nucleic acid molecule
gucaucuucugccuggguu

SEQ ID NO: 703 - RNA, 19 nt, artificial sequence
  Synthetic sequence; antisense nucleic acid molecule
aacccaggcagaagaugac

SEQ ID NO: 704 - RNA, 19 nt, artificial sequence
  Synthetic sequence; sense nucleic acid molecule
ucaucuucugccuggguuc

SEQ ID NO: 705 - RNA, 19 nt, artificial sequence
  Synthetic sequence; antisense nucleic acid molecule
gaacccaggcagaagauga

SEQ ID NO: 706 - RNA, 19 nt, artificial sequence
  Synthetic sequence; sense nucleic acid molecule
caucuucugccuggguucc

SEQ ID NO: 707 - RNA, 19 nt, artificial sequence
  Synthetic sequence; antisense nucleic acid molecule
ggaacccaggcagaagaug

SEQ ID NO: 708 - RNA, 19 nt, artificial sequence
  Synthetic sequence; sense nucleic acid molecule
aucuucugccuggguuccu

SEQ ID NO: 709 - RNA, 19 nt, artificial sequence
  Synthetic sequence; antisense nucleic acid molecule
aggaacccaggcagaagau

SEQ ID NO: 710 - RNA, 19 nt, artificial sequence
  Synthetic sequence; sense nucleic acid molecule
cuucugccuggguuccuau

SEQ ID NO: 711 - RNA, 19 nt, artificial sequence
  Synthetic sequence; antisense nucleic acid molecule
auaggaacccaggcagaag

SEQ ID NO: 712 - RNA, 19 nt, artificial sequence
  Synthetic sequence; sense nucleic acid molecule
uucugccuggguuccuaug

SEQ ID NO: 713 - RNA, 19 nt, artificial sequence
  Synthetic sequence; antisense nucleic acid molecule
cauaggaacccaggcagaa

SEQ ID NO: 714 - RNA, 19 nt, artificial sequence
  Synthetic sequence; sense nucleic acid molecule
ucugccuggguuccuaugg

SEQ ID NO: 715 - RNA, 19 nt, artificial sequence
  Synthetic sequence; antisense nucleic acid molecule
ccauaggaacccaggcaga

SEQ ID NO: 716 - RNA, 19 nt, artificial sequence
  Synthetic sequence; sense nucleic acid molecule
cugccuggguuccuauggc

SEQ ID NO: 717 - RNA, 19 nt, artificial sequence
  Synthetic sequence; antisense nucleic acid molecule
gccauaggaacccaggcag

SEQ ID NO: 718 - RNA, 19 nt, artificial sequence
  Synthetic sequence; sense nucleic acid molecule
gccuggguuccuauggcaa

SEQ ID NO: 719 - RNA, 19 nt, artificial sequence
  Synthetic sequence; antisense nucleic acid molecule
uugccauaggaacccaggc

SEQ ID NO: 720 - RNA, 19 nt, artificial sequence
  Synthetic sequence; sense nucleic acid molecule
ccuggguuccuauggcaac

SEQ ID NO: 721 - RNA, 19 nt, artificial sequence
  Synthetic sequence; antisense nucleic acid molecule
guugccauaggaacccagg

SEQ ID NO: 722 - RNA, 19 nt, artificial sequence
  Synthetic sequence; sense nucleic acid molecule
guuccuauggcaacuucau

SEQ ID NO: 723 - RNA, 19 nt, artificial sequence
  Synthetic sequence; antisense nucleic acid molecule
augaaguugccauaggaac

SEQ ID NO: 724 - RNA, 19 nt, artificial sequence
  Synthetic sequence; sense nucleic acid molecule
uuccuauggcaacuucauu

SEQ ID NO: 725 - RNA, 19 nt, artificial sequence
  Synthetic sequence; antisense nucleic acid molecule
aaugaaguugccauaggaa

SEQ ID NO: 726 - RNA, 19 nt, artificial sequence
  Synthetic sequence; sense nucleic acid molecule
uccuauggcaacuucauug

SEQ ID NO: 727 - RNA, 19 nt, artificial sequence
  Synthetic sequence; antisense nucleic acid molecule
caaugaaguugccauagga

SEQ ID NO: 728 - RNA, 19 nt, artificial sequence
  Synthetic sequence; sense nucleic acid molecule
ccuauggcaacuucauugu

SEQ ID NO: 729 - RNA, 19 nt, artificial sequence
  Synthetic sequence; antisense nucleic acid molecule
acaaugaaguugccauagg

SEQ ID NO: 730 - RNA, 19 nt, artificial sequence
  Synthetic sequence; sense nucleic acid molecule
cuauggcaacuucauuguc

SEQ ID NO: 731 - RNA, 19 nt, artificial sequence
  Synthetic sequence; antisense nucleic acid molecule
gacaaugaaguugccauag

SEQ ID NO: 732 - RNA, 19 nt, artificial sequence
  Synthetic sequence; sense nucleic acid molecule
uauggcaacuucauugucu

SEQ ID NO: 733 - RNA, 19 nt, artificial sequence
  Synthetic sequence; antisense nucleic acid molecule
agacaaugaaguugccaua

SEQ ID NO: 734 - RNA, 19 nt, artificial sequence
  Synthetic sequence; sense nucleic acid molecule
auggcaacuucauugucuu

SEQ ID NO: 735 - RNA, 19 nt, artificial sequence
  Synthetic sequence; antisense nucleic acid molecule
aagacaaugaaguugccau

SEQ ID NO: 736 - RNA, 19 nt, artificial sequence
  Synthetic sequence; sense nucleic acid molecule
uggcaacuucauugucuuc

SEQ ID NO: 737 - RNA, 19 nt, artificial sequence
  Synthetic sequence; antisense nucleic acid molecule
gaagacaaugaaguugcca

SEQ ID NO: 738 - RNA, 19 nt, artificial sequence
  Synthetic sequence; sense nucleic acid molecule
ggcaacuucauugucuucu

SEQ ID NO: 739 - RNA, 19 nt, artificial sequence
  Synthetic sequence; antisense nucleic acid molecule
agaagacaaugaaguugcc

SEQ ID NO: 740 - RNA, 19 nt, artificial sequence
  Synthetic sequence; sense nucleic acid molecule
gcaacuucauugucuucuu

SEQ ID NO: 741 - RNA, 19 nt, artificial sequence
  Synthetic sequence; antisense nucleic acid molecule
aagaagacaaugaaguugc

SEQ ID NO: 742 - RNA, 19 nt, artificial sequence
  Synthetic sequence; sense nucleic acid molecule
caacuucauugucuucuug

SEQ ID NO: 743 - RNA, 19 nt, artificial sequence
  Synthetic sequence; antisense nucleic acid molecule
caagaagacaaugaaguug

SEQ ID NO: 744 - RNA, 19 nt, artificial sequence
  Synthetic sequence; sense nucleic acid molecule
cuucauugucuucuugucc

SEQ ID NO: 745 - RNA, 19 nt, artificial sequence
  Synthetic sequence; antisense nucleic acid molecule
ggacaagaagacaaugaag

SEQ ID NO: 746 - RNA, 19 nt, artificial sequence
  Synthetic sequence; sense nucleic acid molecule
uucauugucuucuuguccu

SEQ ID NO: 747 - RNA, 19 nt, artificial sequence
  Synthetic sequence; antisense nucleic acid molecule
aggacaagaagacaaugaa

SEQ ID NO: 748 - RNA, 19 nt, artificial sequence
  Synthetic sequence; sense nucleic acid molecule
ucauugucuucuuguccuu

SEQ ID NO: 749 - RNA, 19 nt, artificial sequence
  Synthetic sequence; antisense nucleic acid molecule
aaggacaagaagacaauga

SEQ ID NO: 750 - RNA, 19 nt, artificial sequence
  Synthetic sequence; sense nucleic acid molecule
cauugucuucuuguccuuc

SEQ ID NO: 751 - RNA, 19 nt, artificial sequence
  Synthetic sequence; antisense nucleic acid molecule
gaaggacaagaagacaaug

SEQ ID NO: 752 - RNA, 19 nt, artificial sequence
  Synthetic sequence; sense nucleic acid molecule
ugucuucuuguccuucuuc

SEQ ID NO: 753 - RNA, 19 nt, artificial sequence
  Synthetic sequence; antisense nucleic acid molecule
gaagaaggacaagaagaca

SEQ ID NO: 754 - RNA, 19 nt, artificial sequence
  Synthetic sequence; sense nucleic acid molecule
gucuucuuguccuucuucg

SEQ ID NO: 755 - RNA, 19 nt, artificial sequence
  Synthetic sequence; antisense nucleic acid molecule
cgaagaaggacaagaagac

SEQ ID NO: 756 - RNA, 19 nt, artificial sequence
  Synthetic sequence; sense nucleic acid molecule
ucuucuuguccuucuucga

SEQ ID NO: 757 - RNA, 19 nt, artificial sequence
  Synthetic sequence; antisense nucleic acid molecule
ucgaagaaggacaagaaga

SEQ ID NO: 758 - RNA, 19 nt, artificial sequence
  Synthetic sequence; sense nucleic acid molecule
cuucuuguccuucuucgau

SEQ ID NO: 759 - RNA, 19 nt, artificial sequence
  Synthetic sequence; antisense nucleic acid molecule
aucgaagaaggacaagaag

SEQ ID NO: 760 - RNA, 19 nt, artificial sequence
  Synthetic sequence; sense nucleic acid molecule
uuguccuucuucgauccag

SEQ ID NO: 761 - RNA, 19 nt, artificial sequence
  Synthetic sequence; antisense nucleic acid molecule
cuggaucgaagaaggacaa

SEQ ID NO: 762 - RNA, 19 nt, artificial sequence
  Synthetic sequence; sense nucleic acid molecule
uguccuucuucgauccagc

SEQ ID NO: 763 - RNA, 19 nt, artificial sequence
  Synthetic sequence; antisense nucleic acid molecule
gcuggaucgaagaaggaca

SEQ ID NO: 764 - RNA, 19 nt, artificial sequence
  Synthetic sequence; sense nucleic acid molecule
uucuucgauccagccuuca

SEQ ID NO: 765 - RNA, 19 nt, artificial sequence
  Synthetic sequence; antisense nucleic acid molecule
ugaaggcuggaucgaagaa

SEQ ID NO: 766 - RNA, 19 nt, artificial sequence
  Synthetic sequence; sense nucleic acid molecule
ucuucgauccagccuucag

SEQ ID NO: 767 - RNA, 19 nt, artificial sequence
  Synthetic sequence; antisense nucleic acid molecule
cugaaggcuggaucgaaga

SEQ ID NO: 768 - RNA, 19 nt, artificial sequence
  Synthetic sequence; sense nucleic acid molecule
cuucgauccagccuucagg

SEQ ID NO: 769 - RNA, 19 nt, artificial sequence
  Synthetic sequence; antisense nucleic acid molecule
ccugaaggcuggaucgaag

SEQ ID NO: 770 - RNA, 19 nt, artificial sequence
  Synthetic sequence; sense nucleic acid molecule
aacuuugauuucaugaucc

SEQ ID NO: 771 - RNA, 19 nt, artificial sequence
  Synthetic sequence; antisense nucleic acid molecule
ggaucaugaaaucaaaguu

SEQ ID NO: 772 - RNA, 19 nt, artificial sequence
  Synthetic sequence; sense nucleic acid molecule
acuuugauuucaugauccu

SEQ ID NO: 773 - RNA, 19 nt, artificial sequence
  Synthetic sequence; antisense nucleic acid molecule
aggaucaugaaaucaaagu

SEQ ID NO: 774 - RNA, 19 nt, artificial sequence
  Synthetic sequence; sense nucleic acid molecule
cuuugauuucaugauccug

SEQ ID NO: 775 - RNA, 19 nt, artificial sequence
  Synthetic sequence; antisense nucleic acid molecule
caggaucaugaaaucaaag

SEQ ID NO: 776 - RNA, 19 nt, artificial sequence
  Synthetic sequence; sense nucleic acid molecule
uuugauuucaugauccuga

SEQ ID NO: 777 - RNA, 19 nt, artificial sequence
  Synthetic sequence; antisense nucleic acid molecule
ucaggaucaugaaaucaaa

SEQ ID NO: 778 - RNA, 19 nt, artificial sequence
  Synthetic sequence; sense nucleic acid molecule
uguccuucugugaccucuu

SEQ ID NO: 779 - RNA, 19 nt, artificial sequence
  Synthetic sequence; antisense nucleic acid molecule
aagaggucacagaaggaca

SEQ ID NO: 780 - RNA, 19 nt, artificial sequence
  Synthetic sequence; sense nucleic acid molecule
uucugugaccucuucauuu

SEQ ID NO: 781 - RNA, 19 nt, artificial sequence
  Synthetic sequence; antisense nucleic acid molecule
aaaugaagaggucacagaa

SEQ ID NO: 782 - RNA, 19 nt, artificial sequence
  Synthetic sequence; sense nucleic acid molecule
ucugugaccucuucauuug

SEQ ID NO: 783 - RNA, 19 nt, artificial sequence
  Synthetic sequence; antisense nucleic acid molecule
caaaugaagaggucacaga

SEQ ID NO: 784 - RNA, 19 nt, artificial sequence
  Synthetic sequence; sense nucleic acid molecule
cugugaccucuucauuugu

SEQ ID NO: 785 - RNA, 19 nt, artificial sequence
  Synthetic sequence; antisense nucleic acid molecule
acaaaugaagaggucacag

SEQ ID NO: 786 - RNA, 19 nt, artificial sequence
  Synthetic sequence; sense nucleic acid molecule
ugugaccucuucauuugug

SEQ ID NO: 787 - RNA, 19 nt, artificial sequence
  Synthetic sequence; antisense nucleic acid molecule
cacaaaugaagaggucaca

SEQ ID NO: 788 - RNA, 19 nt, artificial sequence
  Synthetic sequence; sense nucleic acid molecule
ugaccucuucauuugugga

SEQ ID NO: 789 - RNA, 19 nt, artificial sequence
  Synthetic sequence; antisense nucleic acid molecule
uccacaaaugaagagguca

SEQ ID NO: 790 - RNA, 19 nt, artificial sequence
  Synthetic sequence; sense nucleic acid molecule
gaccucuucauuuguggag

SEQ ID NO: 791 - RNA, 19 nt, artificial sequence
  Synthetic sequence; antisense nucleic acid molecule
cuccacaaaugaagagguc

SEQ ID NO: 792 - RNA, 19 nt, artificial sequence
  Synthetic sequence; sense nucleic acid molecule
ucauuuguggagugacagc

SEQ ID NO: 793 - RNA, 19 nt, artificial sequence
  Synthetic sequence; antisense nucleic acid molecule
gcugucacuccacaaauga

SEQ ID NO: 794 - RNA, 19 nt, artificial sequence
  Synthetic sequence; sense nucleic acid molecule
cccauguucaccuuugugu

SEQ ID NO: 795 - RNA, 19 nt, artificial sequence
  Synthetic sequence; antisense nucleic acid molecule
acacaaaggugaacauggg

SEQ ID NO: 796 - RNA, 19 nt, artificial sequence
  Synthetic sequence; sense nucleic acid molecule
ccauguucaccuuuguguu

SEQ ID NO: 797 - RNA, 19 nt, artificial sequence
  Synthetic sequence; antisense nucleic acid molecule
aacacaaaggugaacaugg

SEQ ID NO: 798 - RNA, 19 nt, artificial sequence
  Synthetic sequence; sense nucleic acid molecule
cauguucaccuuuguguua

SEQ ID NO: 799 - RNA, 19 nt, artificial sequence
  Synthetic sequence; antisense nucleic acid molecule
uaacacaaaggugaacaug

SEQ ID NO: 800 - RNA, 19 nt, artificial sequence
  Synthetic sequence; sense nucleic acid molecule
auguucaccuuuguguuau

SEQ ID NO: 801 - RNA, 19 nt, artificial sequence
  Synthetic sequence; antisense nucleic acid molecule
auaacacaaaggugaacau

SEQ ID NO: 802 - RNA, 19 nt, artificial sequence
  Synthetic sequence; sense nucleic acid molecule
uguucaccuuuguguuauu

SEQ ID NO: 803 - RNA, 19 nt, artificial sequence
  Synthetic sequence; antisense nucleic acid molecule
aauaacacaaaggugaaca

SEQ ID NO: 804 - RNA, 19 nt, artificial sequence
  Synthetic sequence; sense nucleic acid molecule
guucaccuuuguguuauuc

SEQ ID NO: 805 - RNA, 19 nt, artificial sequence
  Synthetic sequence; antisense nucleic acid molecule
gaauaacacaaaggugaac

SEQ ID NO: 806 - RNA, 19 nt, artificial sequence
  Synthetic sequence; sense nucleic acid molecule
caccuuuguguuauucuuc

SEQ ID NO: 807 - RNA, 19 nt, artificial sequence
  Synthetic sequence; antisense nucleic acid molecule
gaagaauaacacaaaggug

SEQ ID NO: 808 - RNA, 19 nt, artificial sequence
  Synthetic sequence; sense nucleic acid molecule
uuguguuauucuucagcuc

SEQ ID NO: 809 - RNA, 19 nt, artificial sequence
  Synthetic sequence; antisense nucleic acid molecule
gagcugaagaauaacacaa

SEQ ID NO: 810 - RNA, 19 nt, artificial sequence
  Synthetic sequence; sense nucleic acid molecule
uguguuauucuucagcuca

SEQ ID NO: 811 - RNA, 19 nt, artificial sequence
  Synthetic sequence; antisense nucleic acid molecule
ugagcugaagaauaacaca

SEQ ID NO: 812 - RNA, 19 nt, artificial sequence
  Synthetic sequence; sense nucleic acid molecule
guguuauucuucagcucag

SEQ ID NO: 813 - RNA, 19 nt, artificial sequence
  Synthetic sequence; antisense nucleic acid molecule
cugagcugaagaauaacac

SEQ ID NO: 814 - RNA, 19 nt, artificial sequence
  Synthetic sequence; sense nucleic acid molecule
cuucagcucagccaguagu

SEQ ID NO: 815 - RNA, 19 nt, artificial sequence
  Synthetic sequence; antisense nucleic acid molecule
acuacuggcugagcugaag

SEQ ID NO: 816 - RNA, 19 nt, artificial sequence
  Synthetic sequence; sense nucleic acid molecule
uucagcucagccaguagua

SEQ ID NO: 817 - RNA, 19 nt, artificial sequence
  Synthetic sequence; antisense nucleic acid molecule
uacuacuggcugagcugaa

SEQ ID NO: 818 - RNA, 19 nt, artificial sequence
  Synthetic sequence; sense nucleic acid molecule
ucagcucagccaguaguau

SEQ ID NO: 819 - RNA, 19 nt, artificial sequence
  Synthetic sequence; antisense nucleic acid molecule
auacuacuggcugagcuga

SEQ ID NO: 820 - RNA, 19 nt, artificial sequence
  Synthetic sequence; sense nucleic acid molecule
cagcucagccaguaguauc

SEQ ID NO: 821 - RNA, 19 nt, artificial sequence
  Synthetic sequence; antisense nucleic acid molecule
gauacuacuggcugagcug

SEQ ID NO: 822 - RNA, 19 nt, artificial sequence
  Synthetic sequence; sense nucleic acid molecule
agcucagccaguaguaucc

SEQ ID NO: 823 - RNA, 19 nt, artificial sequence
  Synthetic sequence; antisense nucleic acid molecule
ggauacuacuggcugagcu

SEQ ID NO: 824 - RNA, 19 nt, artificial sequence
  Synthetic sequence; sense nucleic acid molecule
gcucagccaguaguauccc

SEQ ID NO: 825 - RNA, 19 nt, artificial sequence
  Synthetic sequence; antisense nucleic acid molecule
gggauacuacuggcugagc

SEQ ID NO: 826 - RNA, 19 nt, artificial sequence
  Synthetic sequence; sense nucleic acid molecule
cucagccaguaguaucccg

SEQ ID NO: 827 - RNA, 19 nt, artificial sequence
  Synthetic sequence; antisense nucleic acid molecule
cgggauacuacuggcugag

SEQ ID NO: 828 - RNA, 19 nt, artificial sequence
  Synthetic sequence; sense nucleic acid molecule
ucagccaguaguaucccgg

SEQ ID NO: 829 - RNA, 19 nt, artificial sequence
  Synthetic sequence; antisense nucleic acid molecule
ccgggauacuacuggcuga

SEQ ID NO: 830 - RNA, 19 nt, artificial sequence
  Synthetic sequence; sense nucleic acid molecule
cagccaguaguaucccgga

SEQ ID NO: 831 - RNA, 19 nt, artificial sequence
  Synthetic sequence; antisense nucleic acid molecule
uccgggauacuacuggcug

SEQ ID NO: 832 - RNA, 19 nt, artificial sequence
  Synthetic sequence; sense nucleic acid molecule
agccaguaguaucccggau

SEQ ID NO: 833 - RNA, 19 nt, artificial sequence
  Synthetic sequence; antisense nucleic acid molecule
auccgggauacuacuggcu

SEQ ID NO: 834 - RNA, 19 nt, artificial sequence
  Synthetic sequence; sense nucleic acid molecule
ucugcuucacuuuccaucu

SEQ ID NO: 835 - RNA, 19 nt, artificial sequence
  Synthetic sequence; antisense nucleic acid molecule
agauggaaagugaagcaga

SEQ ID NO: 836 - RNA, 19 nt, artificial sequence
  Synthetic sequence; sense nucleic acid molecule
cuucacuuuccaucucacc

SEQ ID NO: 837 - RNA, 19 nt, artificial sequence
  Synthetic sequence; antisense nucleic acid molecule
ggugagauggaaagugaag

SEQ ID NO: 838 - RNA, 19 nt, artificial sequence
  Synthetic sequence; sense nucleic acid molecule
uucacuuuccaucucacca

SEQ ID NO: 839 - RNA, 19 nt, artificial sequence
  Synthetic sequence; antisense nucleic acid molecule
uggugagauggaaagugaa

SEQ ID NO: 840 - RNA, 19 nt, artificial sequence
  Synthetic sequence; sense nucleic acid molecule
ucacuuuccaucucaccag

SEQ ID NO: 841 - RNA, 19 nt, artificial sequence
  Synthetic sequence; antisense nucleic acid molecule
cuggugagauggaaaguga

SEQ ID NO: 842 - RNA, 19 nt, artificial sequence
  Synthetic sequence; sense nucleic acid molecule
cacuuuccaucucaccagu

SEQ ID NO: 843 - RNA, 19 nt, artificial sequence
  Synthetic sequence; antisense nucleic acid molecule
acuggugagauggaaagug

SEQ ID NO: 844 - RNA, 19 nt, artificial sequence
  Synthetic sequence; sense nucleic acid molecule
acuuuccaucucaccaguu

SEQ ID NO: 845 - RNA, 19 nt, artificial sequence
  Synthetic sequence; antisense nucleic acid molecule
aacuggugagauggaaagu

SEQ ID NO: 846 - RNA, 19 nt, artificial sequence
  Synthetic sequence; sense nucleic acid molecule
cuuuccaucucaccaguuc

SEQ ID NO: 847 - RNA, 19 nt, artificial sequence
  Synthetic sequence; antisense nucleic acid molecule
gaacuggugagauggaaag

SEQ ID NO: 848 - RNA, 19 nt, artificial sequence
  Synthetic sequence; sense nucleic acid molecule
ccaucucaccaguucaggc

SEQ ID NO: 849 - RNA, 19 nt, artificial sequence
  Synthetic sequence; antisense nucleic acid molecule
gccugaacuggugagaugg

SEQ ID NO: 850 - RNA, 19 nt, artificial sequence
  Synthetic sequence; sense nucleic acid molecule
caucucaccaguucaggcu

SEQ ID NO: 851 - RNA, 19 nt, artificial sequence
  Synthetic sequence; antisense nucleic acid molecule
agccugaacuggugagaug

SEQ ID NO: 852 - RNA, 19 nt, artificial sequence
  Synthetic sequence; sense nucleic acid molecule
aucucaccaguucaggcuu

SEQ ID NO: 853 - RNA, 19 nt, artificial sequence
  Synthetic sequence; antisense nucleic acid molecule
aagccugaacuggugagau

SEQ ID NO: 854 - RNA, 19 nt, artificial sequence
  Synthetic sequence; sense nucleic acid molecule
ucucaccaguucaggcuuc

SEQ ID NO: 855 - RNA, 19 nt, artificial sequence
  Synthetic sequence; antisense nucleic acid molecule
gaagccugaacuggugaga

SEQ ID NO: 856 - RNA, 19 nt, artificial sequence
  Synthetic sequence; sense nucleic acid molecule
accaguucaggcuucauca

SEQ ID NO: 857 - RNA, 19 nt, artificial sequence
  Synthetic sequence; antisense nucleic acid molecule
ugaugaagccugaacuggu

SEQ ID NO: 858 - RNA, 19 nt, artificial sequence
  Synthetic sequence; sense nucleic acid molecule
caguucaggcuucaucauc

SEQ ID NO: 859 - RNA, 19 nt, artificial sequence
  Synthetic sequence; antisense nucleic acid molecule
gaugaugaagccugaacug

SEQ ID NO: 860 - RNA, 19 nt, artificial sequence
  Synthetic sequence; sense nucleic acid molecule
aguucaggcuucaucauca

SEQ ID NO: 861 - RNA, 19 nt, artificial sequence
  Synthetic sequence; antisense nucleic acid molecule
ugaugaugaagccugaacu

SEQ ID NO: 862 - RNA, 19 nt, artificial sequence
  Synthetic sequence; sense nucleic acid molecule
guucaggcuucaucaucau

SEQ ID NO: 863 - RNA, 19 nt, artificial sequence
  Synthetic sequence; antisense nucleic acid molecule
augaugaugaagccugaac

SEQ ID NO: 864 - RNA, 19 nt, artificial sequence
  Synthetic sequence; sense nucleic acid molecule
uucaggcuucaucaucaug

SEQ ID NO: 865 - RNA, 19 nt, artificial sequence
  Synthetic sequence; antisense nucleic acid molecule
caugaugaugaagccugaa

SEQ ID NO: 866 - RNA, 19 nt, artificial sequence
  Synthetic sequence; sense nucleic acid molecule
ucaggcuucaucaucaugu

SEQ ID NO: 867 - RNA, 19 nt, artificial sequence
  Synthetic sequence; antisense nucleic acid molecule
acaugaugaugaagccuga

SEQ ID NO: 868 - RNA, 19 nt, artificial sequence
  Synthetic sequence; sense nucleic acid molecule
caggcuucaucaucauguc

SEQ ID NO: 869 - RNA, 19 nt, artificial sequence
  Synthetic sequence; antisense nucleic acid molecule
gacaugaugaugaagccug

SEQ ID NO: 870 - RNA, 19 nt, artificial sequence
  Synthetic sequence; sense nucleic acid molecule
aggcuucaucaucaugucu

SEQ ID NO: 871 - RNA, 19 nt, artificial sequence
  Synthetic sequence; antisense nucleic acid molecule
agacaugaugaugaagccu

SEQ ID NO: 872 - RNA, 19 nt, artificial sequence
  Synthetic sequence; sense nucleic acid molecule
ggcuucaucaucaugucuc

SEQ ID NO: 873 - RNA, 19 nt, artificial sequence
  Synthetic sequence; antisense nucleic acid molecule
gagacaugaugaugaagcc

SEQ ID NO: 874 - RNA, 19 nt, artificial sequence
  Synthetic sequence; sense nucleic acid molecule
gcuucaucaucaugucucu

SEQ ID NO: 875 - RNA, 19 nt, artificial sequence
  Synthetic sequence; antisense nucleic acid molecule
agagacaugaugaugaagc

SEQ ID NO: 876 - RNA, 19 nt, artificial sequence
  Synthetic sequence; sense nucleic acid molecule
caucaucaugucucugaag

SEQ ID NO: 877 - RNA, 19 nt, artificial sequence
  Synthetic sequence; antisense nucleic acid molecule
cuucagagacaugaugaug

SEQ ID NO: 878 - RNA, 19 nt, artificial sequence
  Synthetic sequence; sense nucleic acid molecule
cucugaagacaguggcagu

SEQ ID NO: 879 - RNA, 19 nt, artificial sequence
  Synthetic sequence; antisense nucleic acid molecule
acugccacugucuucagag

SEQ ID NO: 880 - RNA, 19 nt, artificial sequence
  Synthetic sequence; sense nucleic acid molecule
agacaguggcagugaucgc

SEQ ID NO: 881 - RNA, 19 nt, artificial sequence
  Synthetic sequence; antisense nucleic acid molecule
gcgaucacugccacugucu

SEQ ID NO: 882 - RNA, 19 nt, artificial sequence
  Synthetic sequence; sense nucleic acid molecule
gacaguggcagugaucgcc

SEQ ID NO: 883 - RNA, 19 nt, artificial sequence
  Synthetic sequence; antisense nucleic acid molecule
ggcgaucacugccacuguc

SEQ ID NO: 884 - RNA, 19 nt, artificial sequence
  Synthetic sequence; sense nucleic acid molecule
acaguggcagugaucgccc

SEQ ID NO: 885 - RNA, 19 nt, artificial sequence
  Synthetic sequence; antisense nucleic acid molecule
gggcgaucacugccacugu

SEQ ID NO: 886 - RNA, 19 nt, artificial sequence
  Synthetic sequence; sense nucleic acid molecule
caguggcagugaucgcccu

SEQ ID NO: 887 - RNA, 19 nt, artificial sequence
  Synthetic sequence; antisense nucleic acid molecule
agggcgaucacugccacug

SEQ ID NO: 888 - RNA, 19 nt, artificial sequence
  Synthetic sequence; sense nucleic acid molecule
aguggcagugaucgcccug

SEQ ID NO: 889 - RNA, 19 nt, artificial sequence
  Synthetic sequence; antisense nucleic acid molecule
cagggcgaucacugccacu

SEQ ID NO: 890 - RNA, 19 nt, artificial sequence
  Synthetic sequence; sense nucleic acid molecule
accggcuccggaugguguu

SEQ ID NO: 891 - RNA, 19 nt, artificial sequence
  Synthetic sequence; antisense nucleic acid molecule
aacaccauccggagccggu

SEQ ID NO: 892 - RNA, 19 nt, artificial sequence
  Synthetic sequence; sense nucleic acid molecule
acagccuaaucgcacggcc

SEQ ID NO: 893 - RNA, 19 nt, artificial sequence
  Synthetic sequence; antisense nucleic acid molecule
ggccgugcgauuaggcugu

SEQ ID NO: 894 - RNA, 19 nt, artificial sequence
  Synthetic sequence; sense nucleic acid molecule
cagccuaaucgcacggccu

SEQ ID NO: 895 - RNA, 19 nt, artificial sequence
  Synthetic sequence; antisense nucleic acid molecule
aggccgugcgauuaggcug

SEQ ID NO: 896 - RNA, 19 nt, artificial sequence
  Synthetic sequence; sense nucleic acid molecule
agccuaaucgcacggccuc

SEQ ID NO: 897 - RNA, 19 nt, artificial sequence
  Synthetic sequence; antisense nucleic acid molecule
gaggccgugcgauuaggcu

SEQ ID NO: 898 - RNA, 19 nt, artificial sequence
  Synthetic sequence; sense nucleic acid molecule
gcaccguacuccucacccu

SEQ ID NO: 899 - RNA, 19 nt, artificial sequence
  Synthetic sequence; antisense nucleic acid molecule
agggugaggaguacggugc

SEQ ID NO: 900 - RNA, 19 nt, artificial sequence
  Synthetic sequence; sense nucleic acid molecule
caccguacuccucacccug

SEQ ID NO: 901 - RNA, 19 nt, artificial sequence
  Synthetic sequence; antisense nucleic acid molecule
cagggugaggaguacggug

SEQ ID NO: 902 - RNA, 19 nt, artificial sequence
  Synthetic sequence; sense nucleic acid molecule
cuccucacccugcuucucu

SEQ ID NO: 903 - RNA, 19 nt, artificial sequence
  Synthetic sequence; antisense nucleic acid molecule
agagaagcagggugaggag

SEQ ID NO: 904 - RNA, 19 nt, artificial sequence
  Synthetic sequence; sense nucleic acid molecule
uccucacccugcuucucug

SEQ ID NO: 905 - RNA, 19 nt, artificial sequence
  Synthetic sequence; antisense nucleic acid molecule
cagagaagcagggugagga

SEQ ID NO: 906 - RNA, 19 nt, artificial sequence
  Synthetic sequence; sense nucleic acid molecule
ccucacccugcuucucugg

SEQ ID NO: 907 - RNA, 19 nt, artificial sequence
  Synthetic sequence; antisense nucleic acid molecule
ccagagaagcagggugagg

SEQ ID NO: 908 - RNA, 19 nt, artificial sequence
  Synthetic sequence; sense nucleic acid molecule
cugcuucucugggccacca

SEQ ID NO: 909 - RNA, 19 nt, artificial sequence
  Synthetic sequence; antisense nucleic acid molecule
ugguggcccagagaagcag

SEQ ID NO: 910 - RNA, 19 nt, artificial sequence
  Synthetic sequence; sense nucleic acid molecule
ugggccaccaguuucaccc

SEQ ID NO: 911 - RNA, 19 nt, artificial sequence
  Synthetic sequence; antisense nucleic acid molecule
gggugaaacugguggccca

SEQ ID NO: 912 - RNA, 19 nt, artificial sequence
  Synthetic sequence; sense nucleic acid molecule
gggccaccaguuucacccu

SEQ ID NO: 913 - RNA, 19 nt, artificial sequence
  Synthetic sequence; antisense nucleic acid molecule
agggugaaacugguggccc

SEQ ID NO: 914 - RNA, 19 nt, artificial sequence
  Synthetic sequence; sense nucleic acid molecule
ggccaccaguuucacccuu

SEQ ID NO: 915 - RNA, 19 nt, artificial sequence
  Synthetic sequence; antisense nucleic acid molecule
aagggugaaacugguggcc

SEQ ID NO: 916 - RNA, 19 nt, artificial sequence
  Synthetic sequence; sense nucleic acid molecule
gccaccaguuucacccuug

SEQ ID NO: 917 - RNA, 19 nt, artificial sequence
  Synthetic sequence; antisense nucleic acid molecule
caagggugaaacugguggc

SEQ ID NO: 918 - RNA, 19 nt, artificial sequence
  Synthetic sequence; sense nucleic acid molecule
caguuucacccuugccacc

SEQ ID NO: 919 - RNA, 19 nt, artificial sequence
  Synthetic sequence; antisense nucleic acid molecule
gguggcaagggugaaacug

SEQ ID NO: 920 - RNA, 19 nt, artificial sequence
  Synthetic sequence; sense nucleic acid molecule
aguuucacccuugccaccu

SEQ ID NO: 921 - RNA, 19 nt, artificial sequence
  Synthetic sequence; antisense nucleic acid molecule
agguggcaagggugaaacu

SEQ ID NO: 922 - RNA, 19 nt, artificial sequence
  Synthetic sequence; sense nucleic acid molecule
ccaccuuggcuaccuugaa

SEQ ID NO: 923 - RNA, 19 nt, artificial sequence
  Synthetic sequence; antisense nucleic acid molecule
uucaagguagccaaggugg

SEQ ID NO: 924 - RNA, 19 nt, artificial sequence
  Synthetic sequence; sense nucleic acid molecule
accagcaagucccaccucu

SEQ ID NO: 925 - RNA, 19 nt, artificial sequence
  Synthetic sequence; antisense nucleic acid molecule
agaggugggacuugcuggu

SEQ ID NO: 926 - RNA, 19 nt, artificial sequence
  Synthetic sequence; sense nucleic acid molecule
ccagcaagucccaccucug

SEQ ID NO: 927 - RNA, 19 nt, artificial sequence
  Synthetic sequence; antisense nucleic acid molecule
cagaggugggacuugcugg

SEQ ID NO: 928 - RNA, 19 nt, artificial sequence
  Synthetic sequence; sense nucleic acid molecule
cagcaagucccaccucugu

SEQ ID NO: 929 - RNA, 19 nt, artificial sequence
  Synthetic sequence; antisense nucleic acid molecule
acagaggugggacuugcug

SEQ ID NO: 930 - RNA, 19 nt, artificial sequence
  Synthetic sequence; sense nucleic acid molecule
agcaagucccaccucuguc

SEQ ID NO: 931 - RNA, 19 nt, artificial sequence
  Synthetic sequence; antisense nucleic acid molecule
gacagaggugggacuugcu

SEQ ID NO: 932 - RNA, 19 nt, artificial sequence
  Synthetic sequence; sense nucleic acid molecule
caagucccaccucugucuu

SEQ ID NO: 933 - RNA, 19 nt, artificial sequence
  Synthetic sequence; antisense nucleic acid molecule
aagacagaggugggacuug

SEQ ID NO: 934 - RNA, 19 nt, artificial sequence
  Synthetic sequence; sense nucleic acid molecule
caccucugucuucccaugu

SEQ ID NO: 935 - RNA, 19 nt, artificial sequence
  Synthetic sequence; antisense nucleic acid molecule
acaugggaagacagaggug

SEQ ID NO: 936 - RNA, 19 nt, artificial sequence
  Synthetic sequence; sense nucleic acid molecule
accucugucuucccauguc

SEQ ID NO: 937 - RNA, 19 nt, artificial sequence
  Synthetic sequence; antisense nucleic acid molecule
gacaugggaagacagaggu

SEQ ID NO: 938 - RNA, 19 nt, artificial sequence
  Synthetic sequence; sense nucleic acid molecule
ccucugucuucccaugucc

SEQ ID NO: 939 - RNA, 19 nt, artificial sequence
  Synthetic sequence; antisense nucleic acid molecule
ggacaugggaagacagagg

SEQ ID NO: 940 - RNA, 19 nt, artificial sequence
  Synthetic sequence; sense nucleic acid molecule
cucugucuucccaugucca

SEQ ID NO: 941 - RNA, 19 nt, artificial sequence
  Synthetic sequence; antisense nucleic acid molecule
uggacaugggaagacagag

SEQ ID NO: 942 - RNA, 19 nt, artificial sequence
  Synthetic sequence; sense nucleic acid molecule
ccauguccagucugauugc

SEQ ID NO: 943 - RNA, 19 nt, artificial sequence
  Synthetic sequence; antisense nucleic acid molecule
gcaaucagacuggacaugg

SEQ ID NO: 944 - RNA, 19 nt, artificial sequence
  Synthetic sequence; sense nucleic acid molecule
cauguccagucugauugcu

SEQ ID NO: 945 - RNA, 19 nt, artificial sequence
  Synthetic sequence; antisense nucleic acid molecule
agcaaucagacuggacaug

SEQ ID NO: 946 - RNA, 19 nt, artificial sequence
  Synthetic sequence; sense nucleic acid molecule
auguccagucugauugcug

SEQ ID NO: 947 - RNA, 19 nt, artificial sequence
  Synthetic sequence; antisense nucleic acid molecule
cagcaaucagacuggacau

SEQ ID NO: 948 - RNA, 19 nt, artificial sequence
  Synthetic sequence; sense nucleic acid molecule
aaagccauuuugucucucu

SEQ ID NO: 949 - RNA, 19 nt, artificial sequence
  Synthetic sequence; antisense nucleic acid molecule
agagagacaaaauggcuuu

SEQ ID NO: 950 - RNA, 19 nt, artificial sequence
  Synthetic sequence; sense nucleic acid molecule
aagccauuuugucucucua

SEQ ID NO: 951 - RNA, 19 nt, artificial sequence
  Synthetic sequence; antisense nucleic acid molecule
uagagagacaaaauggcuu

SEQ ID NO: 952 - RNA, 19 nt, artificial sequence
  Synthetic sequence; sense nucleic acid molecule
agccauuuugucucucuau

SEQ ID NO: 953 - RNA, 19 nt, artificial sequence
  Synthetic sequence; antisense nucleic acid molecule
auagagagacaaaauggcu

SEQ ID NO: 954 - RNA, 19 nt, artificial sequence
  Synthetic sequence; sense nucleic acid molecule
gccauuuugucucucuaug

SEQ ID NO: 955 - RNA, 19 nt, artificial sequence
  Synthetic sequence; antisense nucleic acid molecule
cauagagagacaaaauggc

SEQ ID NO: 956 - RNA, 19 nt, artificial sequence
  Synthetic sequence; sense nucleic acid molecule
ugucucucuauguggucga

SEQ ID NO: 957 - RNA, 19 nt, artificial sequence
  Synthetic sequence; antisense nucleic acid molecule
ucgaccacauagagagaca

SEQ ID NO: 958 - RNA, 19 nt, artificial sequence
  Synthetic sequence; sense nucleic acid molecule
gucucucuauguggucgac

SEQ ID NO: 959 - RNA, 19 nt, artificial sequence
  Synthetic sequence; antisense nucleic acid molecule
gucgaccacauagagagac

SEQ ID NO: 960 - RNA, 19 nt, artificial sequence
  Synthetic sequence; sense nucleic acid molecule
ucucucuauguggucgacu

SEQ ID NO: 961 - RNA, 19 nt, artificial sequence
  Synthetic sequence; antisense nucleic acid molecule
agucgaccacauagagaga

SEQ ID NO: 962 - RNA, 19 nt, artificial sequence
  Synthetic sequence; sense nucleic acid molecule
cucucuauguggucgacuu

SEQ ID NO: 963 - RNA, 19 nt, artificial sequence
  Synthetic sequence; antisense nucleic acid molecule
aagucgaccacauagagag

SEQ ID NO: 964 - RNA, 19 nt, artificial sequence
  Synthetic sequence; sense nucleic acid molecule
ucucuauguggucgacuuc

SEQ ID NO: 965 - RNA, 19 nt, artificial sequence
  Synthetic sequence; antisense nucleic acid molecule
gaagucgaccacauagaga

SEQ ID NO: 966 - RNA, 19 nt, artificial sequence
  Synthetic sequence; sense nucleic acid molecule
cucuauguggucgacuuca

SEQ ID NO: 967 - RNA, 19 nt, artificial sequence
  Synthetic sequence; antisense nucleic acid molecule
ugaagucgaccacauagag

SEQ ID NO: 968 - RNA, 19 nt, artificial sequence
  Synthetic sequence; sense nucleic acid molecule
ucuauguggucgacuucac

SEQ ID NO: 969 - RNA, 19 nt, artificial sequence
  Synthetic sequence; antisense nucleic acid molecule
gugaagucgaccacauaga

SEQ ID NO: 970 - RNA, 19 nt, artificial sequence
  Synthetic sequence; sense nucleic acid molecule
cuauguggucgacuucacc

SEQ ID NO: 971 - RNA, 19 nt, artificial sequence
  Synthetic sequence; antisense nucleic acid molecule
ggugaagucgaccacauag

SEQ ID NO: 972 - RNA, 19 nt, artificial sequence
  Synthetic sequence; sense nucleic acid molecule
uauguggucgacuucaccu

SEQ ID NO: 973 - RNA, 19 nt, artificial sequence
  Synthetic sequence; antisense nucleic acid molecule
aggugaagucgaccacaua

SEQ ID NO: 974 - RNA, 19 nt, artificial sequence
  Synthetic sequence; sense nucleic acid molecule
ggucgacuucaccuucugu

SEQ ID NO: 975 - RNA, 19 nt, artificial sequence
  Synthetic sequence; antisense nucleic acid molecule
acagaaggugaagucgacc

SEQ ID NO: 976 - RNA, 19 nt, artificial sequence
  Synthetic sequence; sense nucleic acid molecule
gucgacuucaccuucugug

SEQ ID NO: 977 - RNA, 19 nt, artificial sequence
  Synthetic sequence; antisense nucleic acid molecule
cacagaaggugaagucgac

SEQ ID NO: 978 - RNA, 19 nt, artificial sequence
  Synthetic sequence; sense nucleic acid molecule
ucgacuucaccuucugugu

SEQ ID NO: 979 - RNA, 19 nt, artificial sequence
  Synthetic sequence; antisense nucleic acid molecule
acacagaaggugaagucga

SEQ ID NO: 980 - RNA, 19 nt, artificial sequence
  Synthetic sequence; sense nucleic acid molecule
cgacuucaccuucuguguu

SEQ ID NO: 981 - RNA, 19 nt, artificial sequence
  Synthetic sequence; antisense nucleic acid molecule
aacacagaaggugaagucg

SEQ ID NO: 982 - RNA, 19 nt, artificial sequence
  Synthetic sequence; sense nucleic acid molecule
gacuucaccuucuguguug

SEQ ID NO: 983 - RNA, 19 nt, artificial sequence
  Synthetic sequence; antisense nucleic acid molecule
caacacagaaggugaaguc

SEQ ID NO: 984 - RNA, 19 nt, artificial sequence
  Synthetic sequence; sense nucleic acid molecule
acuucaccuucuguguugc

SEQ ID NO: 985 - RNA, 19 nt, artificial sequence
  Synthetic sequence; antisense nucleic acid molecule
gcaacacagaaggugaagu

SEQ ID NO: 986 - RNA, 19 nt, artificial sequence
  Synthetic sequence; sense nucleic acid molecule
uucaccuucuguguugcug

SEQ ID NO: 987 - RNA, 19 nt, artificial sequence
  Synthetic sequence; antisense nucleic acid molecule
cagcaacacagaaggugaa

SEQ ID NO: 988 - RNA, 19 nt, artificial sequence
  Synthetic sequence; sense nucleic acid molecule
ucaccuucuguguugcugu

SEQ ID NO: 989 - RNA, 19 nt, artificial sequence
  Synthetic sequence; antisense nucleic acid molecule
acagcaacacagaagguga

SEQ ID NO: 990 - RNA, 19 nt, artificial sequence
  Synthetic sequence; sense nucleic acid molecule
caccuucuguguugcugug

SEQ ID NO: 991 - RNA, 19 nt, artificial sequence
  Synthetic sequence; antisense nucleic acid molecule
cacagcaacacagaaggug

SEQ ID NO: 992 - RNA, 19 nt, artificial sequence
  Synthetic sequence; sense nucleic acid molecule
accuucuguguugcugugg

SEQ ID NO: 993 - RNA, 19 nt, artificial sequence
  Synthetic sequence; antisense nucleic acid molecule
ccacagcaacacagaaggu

SEQ ID NO: 994 - RNA, 19 nt, artificial sequence
  Synthetic sequence; sense nucleic acid molecule
ucuguguugcuguggucuc

SEQ ID NO: 995 - RNA, 19 nt, artificial sequence
  Synthetic sequence; antisense nucleic acid molecule
gagaccacagcaacacaga

SEQ ID NO: 996 - RNA, 19 nt, artificial sequence
  Synthetic sequence; sense nucleic acid molecule
cuguguugcuguggucucu

SEQ ID NO: 997 - RNA, 19 nt, artificial sequence
  Synthetic sequence; antisense nucleic acid molecule
agagaccacagcaacacag

SEQ ID NO: 998 - RNA, 19 nt, artificial sequence
  Synthetic sequence; sense nucleic acid molecule
uguguugcuguggucucug

SEQ ID NO: 999 - RNA, 19 nt, artificial sequence
  Synthetic sequence; antisense nucleic acid molecule
cagagaccacagcaacaca

SEQ ID NO: 1000 - RNA, 19 nt, artificial sequence
  Synthetic sequence; sense nucleic acid molecule
guguugcuguggucucugu

SEQ ID NO: 1001 - RNA, 19 nt, artificial sequence
  Synthetic sequence; antisense nucleic acid molecule
acagagaccacagcaacac

SEQ ID NO: 1002 - RNA, 19 nt, artificial sequence
  Synthetic sequence; sense nucleic acid molecule
uguugcuguggucucuguc

SEQ ID NO: 1003 - RNA, 19 nt, artificial sequence
  Synthetic sequence; antisense nucleic acid molecule
gacagagaccacagcaaca

SEQ ID NO: 1004 - RNA, 19 nt, artificial sequence
  Synthetic sequence; sense nucleic acid molecule
uugcuguggucucugucuc

SEQ ID NO: 1005 - RNA, 19 nt, artificial sequence
  Synthetic sequence; antisense nucleic acid molecule
gagacagagaccacagcaa

SEQ ID NO: 1006 - RNA, 19 nt, artificial sequence
  Synthetic sequence; sense nucleic acid molecule
ugcuguggucucugucucu

SEQ ID NO: 1007 - RNA, 19 nt, artificial sequence
  Synthetic sequence; antisense nucleic acid molecule
agagacagagaccacagca

SEQ ID NO: 1008 - RNA, 19 nt, artificial sequence
  Synthetic sequence; sense nucleic acid molecule
gcuguggucucugucucuu

SEQ ID NO: 1009 - RNA, 19 nt, artificial sequence
  Synthetic sequence; antisense nucleic acid molecule
aagagacagagaccacagc

SEQ ID NO: 1010 - RNA, 19 nt, artificial sequence
  Synthetic sequence; sense nucleic acid molecule
cuguggucucugucucuua

SEQ ID NO: 1011 - RNA, 19 nt, artificial sequence
  Synthetic sequence; antisense nucleic acid molecule
uaagagacagagaccacag

SEQ ID NO: 1012 - RNA, 19 nt, artificial sequence
  Synthetic sequence; sense nucleic acid molecule
uguggucucugucucuuac

SEQ ID NO: 1013 - RNA, 19 nt, artificial sequence
  Synthetic sequence; antisense nucleic acid molecule
guaagagacagagaccaca

SEQ ID NO: 1014 - RNA, 19 nt, artificial sequence
  Synthetic sequence; sense nucleic acid molecule
guggucucugucucuuaca

SEQ ID NO: 1015 - RNA, 19 nt, artificial sequence
  Synthetic sequence; antisense nucleic acid molecule
uguaagagacagagaccac

SEQ ID NO: 1016 - RNA, 19 nt, artificial sequence
  Synthetic sequence; sense nucleic acid molecule
ucucugucucuuacaucau

SEQ ID NO: 1017 - RNA, 19 nt, artificial sequence
  Synthetic sequence; antisense nucleic acid molecule
augauguaagagacagaga

SEQ ID NO: 1018 - RNA, 19 nt, artificial sequence
  Synthetic sequence; sense nucleic acid molecule
cucugucucuuacaucaug

SEQ ID NO: 1019 - RNA, 19 nt, artificial sequence
  Synthetic sequence; antisense nucleic acid molecule
caugauguaagagacagag

SEQ ID NO: 1020 - RNA, 19 nt, artificial sequence
  Synthetic sequence; sense nucleic acid molecule
gucucuuacaucaugauug

SEQ ID NO: 1021 - RNA, 19 nt, artificial sequence
  Synthetic sequence; antisense nucleic acid molecule
caaucaugauguaagagac

SEQ ID NO: 1022 - RNA, 19 nt, artificial sequence
  Synthetic sequence; sense nucleic acid molecule
ucucuuacaucaugauugc

SEQ ID NO: 1023 - RNA, 19 nt, artificial sequence
  Synthetic sequence; antisense nucleic acid molecule
gcaaucaugauguaagaga

SEQ ID NO: 1024 - RNA, 19 nt, artificial sequence
  Synthetic sequence; sense nucleic acid molecule
cucuuacaucaugauugcu

SEQ ID NO: 1025 - RNA, 19 nt, artificial sequence
  Synthetic sequence; antisense nucleic acid molecule
agcaaucaugauguaagag

SEQ ID NO: 1026 - RNA, 19 nt, artificial sequence
  Synthetic sequence; sense nucleic acid molecule
ucuuacaucaugauugcuc

SEQ ID NO: 1027 - RNA, 19 nt, artificial sequence
  Synthetic sequence; antisense nucleic acid molecule
gagcaaucaugauguaaga

SEQ ID NO: 1028 - RNA, 19 nt, artificial sequence
  Synthetic sequence; sense nucleic acid molecule
cuuacaucaugauugcuca

SEQ ID NO: 1029 - RNA, 19 nt, artificial sequence
  Synthetic sequence; antisense nucleic acid molecule
ugagcaaucaugauguaag

SEQ ID NO: 1030 - RNA, 19 nt, artificial sequence
  Synthetic sequence; sense nucleic acid molecule
uuacaucaugauugcucag

SEQ ID NO: 1031 - RNA, 19 nt, artificial sequence
  Synthetic sequence; antisense nucleic acid molecule
cugagcaaucaugauguaa

SEQ ID NO: 1032 - RNA, 19 nt, artificial sequence
  Synthetic sequence; sense nucleic acid molecule
uacaucaugauugcucaga

SEQ ID NO: 1033 - RNA, 19 nt, artificial sequence
  Synthetic sequence; antisense nucleic acid molecule
ucugagcaaucaugaugua

SEQ ID NO: 1034 - RNA, 19 nt, artificial sequence
  Synthetic sequence; sense nucleic acid molecule
acaucaugauugcucagac

SEQ ID NO: 1035 - RNA, 19 nt, artificial sequence
  Synthetic sequence; antisense nucleic acid molecule
gucugagcaaucaugaugu

SEQ ID NO: 1036 - RNA, 19 nt, artificial sequence
  Synthetic sequence; sense nucleic acid molecule
caucaugauugcucagacc

SEQ ID NO: 1037 - RNA, 19 nt, artificial sequence
  Synthetic sequence; antisense nucleic acid molecule
ggucugagcaaucaugaug

SEQ ID NO: 1038 - RNA, 19 nt, artificial sequence
  Synthetic sequence; sense nucleic acid molecule
auugcucagacccugcgga

SEQ ID NO: 1039 - RNA, 19 nt, artificial sequence
  Synthetic sequence; antisense nucleic acid molecule
uccgcagggucugagcaau

SEQ ID NO: 1040 - RNA, 19 nt, artificial sequence
  Synthetic sequence; sense nucleic acid molecule
uugcucagacccugcggaa

SEQ ID NO: 1041 - RNA, 19 nt, artificial sequence
  Synthetic sequence; antisense nucleic acid molecule
uuccgcagggucugagcaa

SEQ ID NO: 1042 - RNA, 19 nt, artificial sequence
  Synthetic sequence; sense nucleic acid molecule
ugcucagacccugcggaag

SEQ ID NO: 1043 - RNA, 19 nt, artificial sequence
  Synthetic sequence; antisense nucleic acid molecule
cuuccgcagggucugagca

SEQ ID NO: 1044 - RNA, 19 nt, artificial sequence
  Synthetic sequence; sense nucleic acid molecule
gcucagacccugcggaaga

SEQ ID NO: 1045 - RNA, 19 nt, artificial sequence
  Synthetic sequence; antisense nucleic acid molecule
ucuuccgcagggucugagc

SEQ ID NO: 1046 - RNA, 19 nt, artificial sequence
  Synthetic sequence; sense nucleic acid molecule
cucagacccugcggaagaa

SEQ ID NO: 1047 - RNA, 19 nt, artificial sequence
  Synthetic sequence; antisense nucleic acid molecule
uucuuccgcagggucugag

SEQ ID NO: 1048 - RNA, 19 nt, artificial sequence
  Synthetic sequence; sense nucleic acid molecule
uguaaucacagucgaugcu

SEQ ID NO: 1049 - RNA, 19 nt, artificial sequence
  Synthetic sequence; antisense nucleic acid molecule
agcaucgacugugauuaca

SEQ ID NO: 1050 - RNA, 19 nt, artificial sequence
  Synthetic sequence; sense nucleic acid molecule
guaaucacagucgaugcuu

SEQ ID NO: 1051 - RNA, 19 nt, artificial sequence
  Synthetic sequence; antisense nucleic acid molecule
aagcaucgacugugauuac

SEQ ID NO: 1052 - RNA, 19 nt, artificial sequence
  Synthetic sequence; sense nucleic acid molecule
uaaucacagucgaugcuuc

SEQ ID NO: 1053 - RNA, 19 nt, artificial sequence
  Synthetic sequence; antisense nucleic acid molecule
gaagcaucgacugugauua

SEQ ID NO: 1054 - RNA, 19 nt, artificial sequence
  Synthetic sequence; sense nucleic acid molecule
aaucacagucgaugcuucc

SEQ ID NO: 1055 - RNA, 19 nt, artificial sequence
  Synthetic sequence; antisense nucleic acid molecule
ggaagcaucgacugugauu

SEQ ID NO: 1056 - RNA, 19 nt, artificial sequence
  Synthetic sequence; sense nucleic acid molecule
aucacagucgaugcuucca

SEQ ID NO: 1057 - RNA, 19 nt, artificial sequence
  Synthetic sequence; antisense nucleic acid molecule
uggaagcaucgacugugau

SEQ ID NO: 1058 - RNA, 19 nt, artificial sequence
  Synthetic sequence; sense nucleic acid molecule
ucacagucgaugcuuccag

SEQ ID NO: 1059 - RNA, 19 nt, artificial sequence
  Synthetic sequence; antisense nucleic acid molecule
cuggaagcaucgacuguga

SEQ ID NO: 1060 - RNA, 19 nt, artificial sequence
  Synthetic sequence; sense nucleic acid molecule
cacagucgaugcuuccaga

SEQ ID NO: 1061 - RNA, 19 nt, artificial sequence
  Synthetic sequence; antisense nucleic acid molecule
ucuggaagcaucgacugug

SEQ ID NO: 1062 - RNA, 19 nt, artificial sequence
  Synthetic sequence; sense nucleic acid molecule
acagucgaugcuuccagac

SEQ ID NO: 1063 - RNA, 19 nt, artificial sequence
  Synthetic sequence; antisense nucleic acid molecule
gucuggaagcaucgacugu

SEQ ID NO: 1064 - RNA, 19 nt, artificial sequence
  Synthetic sequence; sense nucleic acid molecule
cagucgaugcuuccagacc

SEQ ID NO: 1065 - RNA, 19 nt, artificial sequence
  Synthetic sequence; antisense nucleic acid molecule
ggucuggaagcaucgacug

SEQ ID NO: 1066 - RNA, 19 nt, artificial sequence
  Synthetic sequence; sense nucleic acid molecule
agucgaugcuuccagacca

SEQ ID NO: 1067 - RNA, 19 nt, artificial sequence
  Synthetic sequence; antisense nucleic acid molecule
uggucuggaagcaucgacu

SEQ ID NO: 1068 - RNA, 19 nt, artificial sequence
  Synthetic sequence; sense nucleic acid molecule
gucgaugcuuccagaccac

SEQ ID NO: 1069 - RNA, 19 nt, artificial sequence
  Synthetic sequence; antisense nucleic acid molecule
guggucuggaagcaucgac

SEQ ID NO: 1070 - RNA, 19 nt, artificial sequence
  Synthetic sequence; sense nucleic acid molecule
ucgaugcuuccagaccaca

SEQ ID NO: 1071 - RNA, 19 nt, artificial sequence
  Synthetic sequence; antisense nucleic acid molecule
uguggucuggaagcaucga

SEQ ID NO: 1072 - RNA, 19 nt, artificial sequence
  Synthetic sequence; sense nucleic acid molecule
agaccacagccuuucaugg

SEQ ID NO: 1073 - RNA, 19 nt, artificial sequence
  Synthetic sequence; antisense nucleic acid molecule
ccaugaaaggcuguggucu

SEQ ID NO: 1074 - RNA, 19 nt, artificial sequence
  Synthetic sequence; sense nucleic acid molecule
gaccacagccuuucauggg

SEQ ID NO: 1075 - RNA, 19 nt, artificial sequence
  Synthetic sequence; antisense nucleic acid molecule
cccaugaaaggcugugguc

SEQ ID NO: 1076 - RNA, 19 nt, artificial sequence
  Synthetic sequence; sense nucleic acid molecule
agaucccauccagugugcc

SEQ ID NO: 1077 - RNA, 19 nt, artificial sequence
  Synthetic sequence; antisense nucleic acid molecule
ggcacacuggaugggaucu

SEQ ID NO: 1078 - RNA, 19 nt, artificial sequence
  Synthetic sequence; sense nucleic acid molecule
gaucccauccagugugcca

SEQ ID NO: 1079 - RNA, 19 nt, artificial sequence
  Synthetic sequence; antisense nucleic acid molecule
uggcacacuggaugggauc

SEQ ID NO: 1080 - RNA, 19 nt, artificial sequence
  Synthetic sequence; sense nucleic acid molecule
ccauccagugugccaugcc

SEQ ID NO: 1081 - RNA, 19 nt, artificial sequence
  Synthetic sequence; antisense nucleic acid molecule
ggcauggcacacuggaugg

SEQ ID NO: 1082 - RNA, 19 nt, artificial sequence
  Synthetic sequence; sense nucleic acid molecule
cauccagugugccaugccg

SEQ ID NO: 1083 - RNA, 19 nt, artificial sequence
  Synthetic sequence; antisense nucleic acid molecule
cggcauggcacacuggaug

SEQ ID NO: 1084 - RNA, 19 nt, artificial sequence
  Synthetic sequence; sense nucleic acid molecule
auccagugugccaugccgg

SEQ ID NO: 1085 - RNA, 19 nt, artificial sequence
  Synthetic sequence; antisense nucleic acid molecule
ccggcauggcacacuggau

SEQ ID NO: 1086 - RNA, 19 nt, artificial sequence
  Synthetic sequence; sense nucleic acid molecule
aacugcagcacguucagac

SEQ ID NO: 1087 - RNA, 19 nt, artificial sequence
  Synthetic sequence; antisense nucleic acid molecule
gucugaacgugcugcaguu

SEQ ID NO: 1088 - RNA, 19 nt, artificial sequence
  Synthetic sequence; sense nucleic acid molecule
acugcagcacguucagacc

SEQ ID NO: 1089 - RNA, 19 nt, artificial sequence
  Synthetic sequence; antisense nucleic acid molecule
ggucugaacgugcugcagu

SEQ ID NO: 1090 - RNA, 19 nt, artificial sequence
  Synthetic sequence; sense nucleic acid molecule
uggauauaccaagaguccc

SEQ ID NO: 1091 - RNA, 19 nt, artificial sequence
  Synthetic sequence; antisense nucleic acid molecule
gggacucuugguauaucca

SEQ ID NO: 1092 - RNA, 19 nt, artificial sequence
  Synthetic sequence; sense nucleic acid molecule
ggauauaccaagaguccca

SEQ ID NO: 1093 - RNA, 19 nt, artificial sequence
  Synthetic sequence; antisense nucleic acid molecule
ugggacucuugguauaucc

SEQ ID NO: 1094 - RNA, 19 nt, artificial sequence
  Synthetic sequence; sense nucleic acid molecule
gauauaccaagagucccaa

SEQ ID NO: 1095 - RNA, 19 nt, artificial sequence
  Synthetic sequence; antisense nucleic acid molecule
uugggacucuugguauauc

SEQ ID NO: 1096 - RNA, 19 nt, artificial sequence
  Synthetic sequence; sense nucleic acid molecule
auauaccaagagucccaac

SEQ ID NO: 1097 - RNA, 19 nt, artificial sequence
  Synthetic sequence; antisense nucleic acid molecule
guugggacucuugguauau

SEQ ID NO: 1098 - RNA, 19 nt, artificial sequence
  Synthetic sequence; sense nucleic acid molecule
cagcaagccgacuccagcu

SEQ ID NO: 1099 - RNA, 19 nt, artificial sequence
  Synthetic sequence; antisense nucleic acid molecule
agcuggagucggcuugcug

SEQ ID NO: 1100 - RNA, 19 nt, artificial sequence
  Synthetic sequence; sense nucleic acid molecule
agcaagccgacuccagcuc

SEQ ID NO: 1101 - RNA, 19 nt, artificial sequence
  Synthetic sequence; antisense nucleic acid molecule
gagcuggagucggcuugcu

SEQ ID NO: 1102 - RNA, 19 nt, artificial sequence
  Synthetic sequence; sense nucleic acid molecule
caagccgacuccagcucgu

SEQ ID NO: 1103 - RNA, 19 nt, artificial sequence
  Synthetic sequence; antisense nucleic acid molecule
acgagcuggagucggcuug

SEQ ID NO: 1104 - RNA, 19 nt, artificial sequence
  Synthetic sequence; sense nucleic acid molecule
aagccgacuccagcucgua

SEQ ID NO: 1105 - RNA, 19 nt, artificial sequence
  Synthetic sequence; antisense nucleic acid molecule
uacgagcuggagucggcuu

SEQ ID NO: 1106 - RNA, 19 nt, artificial sequence
  Synthetic sequence; sense nucleic acid molecule
agccgacuccagcucguau

SEQ ID NO: 1107 - RNA, 19 nt, artificial sequence
  Synthetic sequence; antisense nucleic acid molecule
auacgagcuggagucggcu

SEQ ID NO: 1108 - RNA, 19 nt, artificial sequence
  Synthetic sequence; sense nucleic acid molecule
gccgacuccagcucguauc

SEQ ID NO: 1109 - RNA, 19 nt, artificial sequence
  Synthetic sequence; antisense nucleic acid molecule
gauacgagcuggagucggc

SEQ ID NO: 1110 - RNA, 19 nt, artificial sequence
  Synthetic sequence; sense nucleic acid molecule
ccgacuccagcucguauca

SEQ ID NO: 1111 - RNA, 19 nt, artificial sequence
  Synthetic sequence; antisense nucleic acid molecule
ugauacgagcuggagucgg

SEQ ID NO: 1112 - RNA, 19 nt, artificial sequence
  Synthetic sequence; sense nucleic acid molecule
cgacuccagcucguaucag

SEQ ID NO: 1113 - RNA, 19 nt, artificial sequence
  Synthetic sequence; antisense nucleic acid molecule
cugauacgagcuggagucg

SEQ ID NO: 1114 - RNA, 19 nt, artificial sequence
  Synthetic sequence; sense nucleic acid molecule
gacuccagcucguaucagc

SEQ ID NO: 1115 - RNA, 19 nt, artificial sequence
  Synthetic sequence; antisense nucleic acid molecule
gcugauacgagcuggaguc

SEQ ID NO: 1116 - RNA, 19 nt, artificial sequence
  Synthetic sequence; sense nucleic acid molecule
acuccagcucguaucagcc

SEQ ID NO: 1117 - RNA, 19 nt, artificial sequence
  Synthetic sequence; antisense nucleic acid molecule
ggcugauacgagcuggagu

SEQ ID NO: 1118 - RNA, 19 nt, artificial sequence
  Synthetic sequence; sense nucleic acid molecule
agcucguaucagccaucaa

SEQ ID NO: 1119 - RNA, 19 nt, artificial sequence
  Synthetic sequence; antisense nucleic acid molecule
uugauggcugauacgagcu

SEQ ID NO: 1120 - RNA, 19 nt, artificial sequence
  Synthetic sequence; sense nucleic acid molecule
gcucguaucagccaucaac

SEQ ID NO: 1121 - RNA, 19 nt, artificial sequence
  Synthetic sequence; antisense nucleic acid molecule
guugauggcugauacgagc

SEQ ID NO: 1122 - RNA, 19 nt, artificial sequence
  Synthetic sequence; sense nucleic acid molecule
agccaucaaccucuccacu

SEQ ID NO: 1123 - RNA, 19 nt, artificial sequence
  Synthetic sequence; antisense nucleic acid molecule
aguggagagguugauggcu

SEQ ID NO: 1124 - RNA, 19 nt, artificial sequence
  Synthetic sequence; sense nucleic acid molecule
cuccacugccaaggauucc

SEQ ID NO: 1125 - RNA, 19 nt, artificial sequence
  Synthetic sequence; antisense nucleic acid molecule
ggaauccuuggcaguggag

SEQ ID NO: 1126 - RNA, 19 nt, artificial sequence
  Synthetic sequence; sense nucleic acid molecule
cacugccaaggauuccaaa

SEQ ID NO: 1127 - RNA, 19 nt, artificial sequence
  Synthetic sequence; antisense nucleic acid molecule
uuuggaauccuuggcagug

SEQ ID NO: 1128 - RNA, 19 nt, artificial sequence
  Synthetic sequence; sense nucleic acid molecule
caccugugugaucauugug

SEQ ID NO: 1129 - RNA, 19 nt, artificial sequence
  Synthetic sequence; antisense nucleic acid molecule
cacaaugaucacacaggug

SEQ ID NO: 1130 - RNA, 19 nt, artificial sequence
  Synthetic sequence; sense nucleic acid molecule
accugugugaucauugugc

SEQ ID NO: 1131 - RNA, 19 nt, artificial sequence
  Synthetic sequence; antisense nucleic acid molecule
gcacaaugaucacacaggu

SEQ ID NO: 1132 - RNA, 19 nt, artificial sequence
  Synthetic sequence; sense nucleic acid molecule
ccugugugaucauugugcu

SEQ ID NO: 1133 - RNA, 19 nt, artificial sequence
  Synthetic sequence; antisense nucleic acid molecule
agcacaaugaucacacagg

SEQ ID NO: 1134 - RNA, 19 nt, artificial sequence
  Synthetic sequence; sense nucleic acid molecule
ugugaucauugugcuguca

SEQ ID NO: 1135 - RNA, 19 nt, artificial sequence
  Synthetic sequence; antisense nucleic acid molecule
ugacagcacaaugaucaca

SEQ ID NO: 1136 - RNA, 19 nt, artificial sequence
  Synthetic sequence; sense nucleic acid molecule
gugaucauugugcugucag

SEQ ID NO: 1137 - RNA, 19 nt, artificial sequence
  Synthetic sequence; antisense nucleic acid molecule
cugacagcacaaugaucac

SEQ ID NO: 1138 - RNA, 19 nt, artificial sequence
  Synthetic sequence; sense nucleic acid molecule
ugaucauugugcugucagu

SEQ ID NO: 1139 - RNA, 19 nt, artificial sequence
  Synthetic sequence; antisense nucleic acid molecule
acugacagcacaaugauca

SEQ ID NO: 1140 - RNA, 19 nt, artificial sequence
  Synthetic sequence; sense nucleic acid molecule
gaucauugugcugucaguc

SEQ ID NO: 1141 - RNA, 19 nt, artificial sequence
  Synthetic sequence; antisense nucleic acid molecule
gacugacagcacaaugauc

SEQ ID NO: 1142 - RNA, 19 nt, artificial sequence
  Synthetic sequence; sense nucleic acid molecule
aucauugugcugucagucc

SEQ ID NO: 1143 - RNA, 19 nt, artificial sequence
  Synthetic sequence; antisense nucleic acid molecule
ggacugacagcacaaugau

SEQ ID NO: 1144 - RNA, 19 nt, artificial sequence
  Synthetic sequence; sense nucleic acid molecule
ucauugugcugucaguccu

SEQ ID NO: 1145 - RNA, 19 nt, artificial sequence
  Synthetic sequence; antisense nucleic acid molecule
aggacugacagcacaauga

SEQ ID NO: 1146 - RNA, 19 nt, artificial sequence
  Synthetic sequence; sense nucleic acid molecule
cauugugcugucaguccug

SEQ ID NO: 1147 - RNA, 19 nt, artificial sequence
  Synthetic sequence; antisense nucleic acid molecule
caggacugacagcacaaug

SEQ ID NO: 1148 - RNA, 19 nt, artificial sequence
  Synthetic sequence; sense nucleic acid molecule
gugcugucaguccuggugu

SEQ ID NO: 1149 - RNA, 19 nt, artificial sequence
  Synthetic sequence; antisense nucleic acid molecule
acaccaggacugacagcac

SEQ ID NO: 1150 - RNA, 19 nt, artificial sequence
  Synthetic sequence; sense nucleic acid molecule
ugcugucaguccuggugug

SEQ ID NO: 1151 - RNA, 19 nt, artificial sequence
  Synthetic sequence; antisense nucleic acid molecule
cacaccaggacugacagca

SEQ ID NO: 1152 - RNA, 19 nt, artificial sequence
  Synthetic sequence; sense nucleic acid molecule
cugucaguccuggugugcu

SEQ ID NO: 1153 - RNA, 19 nt, artificial sequence
  Synthetic sequence; antisense nucleic acid molecule
agcacaccaggacugacag

SEQ ID NO: 1154 - RNA, 19 nt, artificial sequence
  Synthetic sequence; sense nucleic acid molecule
caguccuggugugcugucu

SEQ ID NO: 1155 - RNA, 19 nt, artificial sequence
  Synthetic sequence; antisense nucleic acid molecule
agacagcacaccaggacug

SEQ ID NO: 1156 - RNA, 19 nt, artificial sequence
  Synthetic sequence; sense nucleic acid molecule
aguccuggugugcugucuu

SEQ ID NO: 1157 - RNA, 19 nt, artificial sequence
  Synthetic sequence; antisense nucleic acid molecule
aagacagcacaccaggacu

SEQ ID NO: 1158 - RNA, 19 nt, artificial sequence
  Synthetic sequence; sense nucleic acid molecule
guccuggugugcugucuuc

SEQ ID NO: 1159 - RNA, 19 nt, artificial sequence
  Synthetic sequence; antisense nucleic acid molecule
gaagacagcacaccaggac

SEQ ID NO: 1160 - RNA, 19 nt, artificial sequence
  Synthetic sequence; sense nucleic acid molecule
uggugugcugucuuccacu

SEQ ID NO: 1161 - RNA, 19 nt, artificial sequence
  Synthetic sequence; antisense nucleic acid molecule
aguggaagacagcacacca

SEQ ID NO: 1162 - RNA, 19 nt, artificial sequence
  Synthetic sequence; sense nucleic acid molecule
auuuccuugguacaggugg

SEQ ID NO: 1163 - RNA, 19 nt, artificial sequence
  Synthetic sequence; antisense nucleic acid molecule
ccaccuguaccaaggaaau

SEQ ID NO: 1164 - RNA, 19 nt, artificial sequence
  Synthetic sequence; sense nucleic acid molecule
uuccuugguacaggugguu

SEQ ID NO: 1165 - RNA, 19 nt, artificial sequence
  Synthetic sequence; antisense nucleic acid molecule
aaccaccuguaccaaggaa

SEQ ID NO: 1166 - RNA, 19 nt, artificial sequence
  Synthetic sequence; sense nucleic acid molecule
uccuugguacaggugguuc

SEQ ID NO: 1167 - RNA, 19 nt, artificial sequence
  Synthetic sequence; antisense nucleic acid molecule
gaaccaccuguaccaagga

SEQ ID NO: 1168 - RNA, 19 nt, artificial sequence
  Synthetic sequence; sense nucleic acid molecule
ccuugguacaggugguucu

SEQ ID NO: 1169 - RNA, 19 nt, artificial sequence
  Synthetic sequence; antisense nucleic acid molecule
agaaccaccuguaccaagg

SEQ ID NO: 1170 - RNA, 19 nt, artificial sequence
  Synthetic sequence; sense nucleic acid molecule
acaggugguucucuccagc

SEQ ID NO: 1171 - RNA, 19 nt, artificial sequence
  Synthetic sequence; antisense nucleic acid molecule
gcuggagagaaccaccugu

SEQ ID NO: 1172 - RNA, 19 nt, artificial sequence
  Synthetic sequence; sense nucleic acid molecule
caggugguucucuccagca

SEQ ID NO: 1173 - RNA, 19 nt, artificial sequence
  Synthetic sequence; antisense nucleic acid molecule
ugcuggagagaaccaccug

SEQ ID NO: 1174 - RNA, 19 nt, artificial sequence
  Synthetic sequence; sense nucleic acid molecule
aggugguucucuccagcaa

SEQ ID NO: 1175 - RNA, 19 nt, artificial sequence
  Synthetic sequence; antisense nucleic acid molecule
uugcuggagagaaccaccu

SEQ ID NO: 1176 - RNA, 19 nt, artificial sequence
  Synthetic sequence; sense nucleic acid molecule
ggugguucucuccagcaau

SEQ ID NO: 1177 - RNA, 19 nt, artificial sequence
  Synthetic sequence; antisense nucleic acid molecule
auugcuggagagaaccacc

SEQ ID NO: 1178 - RNA, 19 nt, artificial sequence
  Synthetic sequence; sense nucleic acid molecule
gugguucucuccagcaaug

SEQ ID NO: 1179 - RNA, 19 nt, artificial sequence
  Synthetic sequence; antisense nucleic acid molecule
cauugcuggagagaaccac

SEQ ID NO: 1180 - RNA, 19 nt, artificial sequence
  Synthetic sequence; sense nucleic acid molecule
ugguucucuccagcaaugg

SEQ ID NO: 1181 - RNA, 19 nt, artificial sequence
  Synthetic sequence; antisense nucleic acid molecule
ccauugcuggagagaacca

SEQ ID NO: 1182 - RNA, 19 nt, artificial sequence
  Synthetic sequence; sense nucleic acid molecule
gguucucuccagcaauggg

SEQ ID NO: 1183 - RNA, 19 nt, artificial sequence
  Synthetic sequence; antisense nucleic acid molecule
cccauugcuggagagaacc

SEQ ID NO: 1184 - RNA, 19 nt, artificial sequence
  Synthetic sequence; sense nucleic acid molecule
guucucuccagcaauggga

SEQ ID NO: 1185 - RNA, 19 nt, artificial sequence
  Synthetic sequence; antisense nucleic acid molecule
ucccauugcuggagagaac

SEQ ID NO: 1186 - RNA, 19 nt, artificial sequence
  Synthetic sequence; sense nucleic acid molecule
gggagcuucauucuuuacc

SEQ ID NO: 1187 - RNA, 19 nt, artificial sequence
  Synthetic sequence; antisense nucleic acid molecule
gguaaagaaugaagcuccc

SEQ ID NO: 1188 - RNA, 19 nt, artificial sequence
  Synthetic sequence; sense nucleic acid molecule
ggagcuucauucuuuacca

SEQ ID NO: 1189 - RNA, 19 nt, artificial sequence
  Synthetic sequence; antisense nucleic acid molecule
ugguaaagaaugaagcucc

SEQ ID NO: 1190 - RNA, 19 nt, artificial sequence
  Synthetic sequence; sense nucleic acid molecule
gcuucauucuuuaccaguu

SEQ ID NO: 1191 - RNA, 19 nt, artificial sequence
  Synthetic sequence; antisense nucleic acid molecule
aacugguaaagaaugaagc

SEQ ID NO: 1192 - RNA, 19 nt, artificial sequence
  Synthetic sequence; sense nucleic acid molecule
uucauucuuuaccaguuug

SEQ ID NO: 1193 - RNA, 19 nt, artificial sequence
  Synthetic sequence; antisense nucleic acid molecule
caaacugguaaagaaugaa

SEQ ID NO: 1194 - RNA, 19 nt, artificial sequence
  Synthetic sequence; sense nucleic acid molecule
ucauucuuuaccaguuuga

SEQ ID NO: 1195 - RNA, 19 nt, artificial sequence
  Synthetic sequence; antisense nucleic acid molecule
ucaaacugguaaagaauga

SEQ ID NO: 1196 - RNA, 19 nt, artificial sequence
  Synthetic sequence; sense nucleic acid molecule
ucuuuaccaguuugaauug

SEQ ID NO: 1197 - RNA, 19 nt, artificial sequence
  Synthetic sequence; antisense nucleic acid molecule
caauucaaacugguaaaga

SEQ ID NO: 1198 - RNA, 19 nt, artificial sequence
  Synthetic sequence; sense nucleic acid molecule
cuuuaccaguuugaauugu

SEQ ID NO: 1199 - RNA, 19 nt, artificial sequence
  Synthetic sequence; antisense nucleic acid molecule
acaauucaaacugguaaag

SEQ ID NO: 1200 - RNA, 19 nt, artificial sequence
  Synthetic sequence; sense nucleic acid molecule
gaauuguuuggauuuacuc

SEQ ID NO: 1201 - RNA, 19 nt, artificial sequence
  Synthetic sequence; antisense nucleic acid molecule
gaguaaauccaaacaauuc

SEQ ID NO: 1202 - RNA, 19 nt, artificial sequence
  Synthetic sequence; sense nucleic acid molecule
acccuuuuauauauucucg

SEQ ID NO: 1203 - RNA, 19 nt, artificial sequence
  Synthetic sequence; antisense nucleic acid molecule
cgagaauauauaaaagggu

SEQ ID NO: 1204 - RNA, 19 nt, artificial sequence
  Synthetic sequence; sense nucleic acid molecule
cccuuuuauauauucucgg

SEQ ID NO: 1205 - RNA, 19 nt, artificial sequence
  Synthetic sequence; antisense nucleic acid molecule
ccgagaauauauaaaaggg

SEQ ID NO: 1206 - RNA, 19 nt, artificial sequence
  Synthetic sequence; sense nucleic acid molecule
ccuuuuauauauucucgga

SEQ ID NO: 1207 - RNA, 19 nt, artificial sequence
  Synthetic sequence; antisense nucleic acid molecule
uccgagaauauauaaaagg

SEQ ID NO: 1208 - RNA, 19 nt, artificial sequence
  Synthetic sequence; sense nucleic acid molecule
ugcucuggugccuccaaua

SEQ ID NO: 1209 - RNA, 19 nt, artificial sequence
  Synthetic sequence; antisense nucleic acid molecule
uauuggaggcaccagagca

SEQ ID NO: 1210 - RNA, 19 nt, artificial sequence
  Synthetic sequence; sense nucleic acid molecule
gcucuggugccuccaauac

SEQ ID NO: 1211 - RNA, 19 nt, artificial sequence
  Synthetic sequence; antisense nucleic acid molecule
guauuggaggcaccagagc

SEQ ID NO: 1212 - RNA, 19 nt, artificial sequence
  Synthetic sequence; sense nucleic acid molecule
cucuggugccuccaauaca

SEQ ID NO: 1213 - RNA, 19 nt, artificial sequence
  Synthetic sequence; antisense nucleic acid molecule
uguauuggaggcaccagag

SEQ ID NO: 1214 - RNA, 19 nt, artificial sequence
  Synthetic sequence; sense nucleic acid molecule
ucuggugccuccaauacau

SEQ ID NO: 1215 - RNA, 19 nt, artificial sequence
  Synthetic sequence; antisense nucleic acid molecule
auguauuggaggcaccaga

SEQ ID NO: 1216 - RNA, 19 nt, artificial sequence
  Synthetic sequence; sense nucleic acid molecule
cuggugccuccaauacaua

SEQ ID NO: 1217 - RNA, 19 nt, artificial sequence
  Synthetic sequence; antisense nucleic acid molecule
uauguauuggaggcaccag

SEQ ID NO: 1218 - RNA, 19 nt, artificial sequence
  Synthetic sequence; sense nucleic acid molecule
uggugccuccaauacauag

SEQ ID NO: 1219 - RNA, 19 nt, artificial sequence
  Synthetic sequence; antisense nucleic acid molecule
cuauguauuggaggcacca

SEQ ID NO: 1220 - RNA, 19 nt, artificial sequence
  Synthetic sequence; sense nucleic acid molecule
ggugccuccaauacauagg

SEQ ID NO: 1221 - RNA, 19 nt, artificial sequence
  Synthetic sequence; antisense nucleic acid molecule
ccuauguauuggaggcacc

SEQ ID NO: 1222 - RNA, 19 nt, artificial sequence
  Synthetic sequence; sense nucleic acid molecule
ccuccaauacauaggccug

SEQ ID NO: 1223 - RNA, 19 nt, artificial sequence
  Synthetic sequence; antisense nucleic acid molecule
caggccuauguauuggagg

SEQ ID NO: 1224 - RNA, 19 nt, artificial sequence
  Synthetic sequence; sense nucleic acid molecule
cuccaauacauaggccugg

SEQ ID NO: 1225 - RNA, 19 nt, artificial sequence
  Synthetic sequence; antisense nucleic acid molecule
ccaggccuauguauuggag

SEQ ID NO: 1226 - RNA, 19 nt, artificial sequence
  Synthetic sequence; sense nucleic acid molecule
uccaauacauaggccuggg

SEQ ID NO: 1227 - RNA, 19 nt, artificial sequence
  Synthetic sequence; antisense nucleic acid molecule
cccaggccuauguauugga

SEQ ID NO: 1228 - RNA, 19 nt, artificial sequence
  Synthetic sequence; sense nucleic acid molecule
ccaauacauaggccugggu

SEQ ID NO: 1229 - RNA, 19 nt, artificial sequence
  Synthetic sequence; antisense nucleic acid molecule
acccaggccuauguauugg

SEQ ID NO: 1230 - RNA, 19 nt, artificial sequence
  Synthetic sequence; sense nucleic acid molecule
caauacauaggccuggguu

SEQ ID NO: 1231 - RNA, 19 nt, artificial sequence
  Synthetic sequence; antisense nucleic acid molecule
aacccaggccuauguauug

SEQ ID NO: 1232 - RNA, 19 nt, artificial sequence
  Synthetic sequence; sense nucleic acid molecule
aauacauaggccuggguuu

SEQ ID NO: 1233 - RNA, 19 nt, artificial sequence
  Synthetic sequence; antisense nucleic acid molecule
aaacccaggccuauguauu

SEQ ID NO: 1234 - RNA, 19 nt, artificial sequence
  Synthetic sequence; sense nucleic acid molecule
auacauaggccuggguuuu

SEQ ID NO: 1235 - RNA, 19 nt, artificial sequence
  Synthetic sequence; antisense nucleic acid molecule
aaaacccaggccuauguau

SEQ ID NO: 1236 - RNA, 19 nt, artificial sequence
  Synthetic sequence; sense nucleic acid molecule
ucgacuucgagccauggga

SEQ ID NO: 1237 - RNA, 19 nt, artificial sequence
  Synthetic sequence; antisense nucleic acid molecule
ucccauggcucgaagucga

SEQ ID NO: 1238 - RNA, 19 nt, artificial sequence
  Synthetic sequence; sense nucleic acid molecule
cgacuucgagccaugggaa

SEQ ID NO: 1239 - RNA, 19 nt, artificial sequence
  Synthetic sequence; antisense nucleic acid molecule
uucccauggcucgaagucg

SEQ ID NO: 1240 - RNA, 19 nt, artificial sequence
  Synthetic sequence; sense nucleic acid molecule
aacucugccuacauguuau

SEQ ID NO: 1241 - RNA, 19 nt, artificial sequence
  Synthetic sequence; antisense nucleic acid molecule
auaacauguaggcagaguu

SEQ ID NO: 1242 - RNA, 19 nt, artificial sequence
  Synthetic sequence; sense nucleic acid molecule
acucugccuacauguuauc

SEQ ID NO: 1243 - RNA, 19 nt, artificial sequence
  Synthetic sequence; antisense nucleic acid molecule
gauaacauguaggcagagu

SEQ ID NO: 1244 - RNA, 19 nt, artificial sequence
  Synthetic sequence; sense nucleic acid molecule
ucugccuacauguuaucuc

SEQ ID NO: 1245 - RNA, 19 nt, artificial sequence
  Synthetic sequence; antisense nucleic acid molecule
gagauaacauguaggcaga

SEQ ID NO: 1246 - RNA, 19 nt, artificial sequence
  Synthetic sequence; sense nucleic acid molecule
cugccuacauguuaucucc

SEQ ID NO: 1247 - RNA, 19 nt, artificial sequence
  Synthetic sequence; antisense nucleic acid molecule
ggagauaacauguaggcag

SEQ ID NO: 1248 - RNA, 19 nt, artificial sequence
  Synthetic sequence; sense nucleic acid molecule
ugccuacauguuaucucca

SEQ ID NO: 1249 - RNA, 19 nt, artificial sequence
  Synthetic sequence; antisense nucleic acid molecule
uggagauaacauguaggca

SEQ ID NO: 1250 - RNA, 19 nt, artificial sequence
  Synthetic sequence; sense nucleic acid molecule
gccuacauguuaucuccaa

SEQ ID NO: 1251 - RNA, 19 nt, artificial sequence
  Synthetic sequence; antisense nucleic acid molecule
uuggagauaacauguaggc

SEQ ID NO: 1252 - RNA, 19 nt, artificial sequence
  Synthetic sequence; sense nucleic acid molecule
ccuacauguuaucuccaaa

SEQ ID NO: 1253 - RNA, 19 nt, artificial sequence
  Synthetic sequence; antisense nucleic acid molecule
uuuggagauaacauguagg

SEQ ID NO: 1254 - RNA, 19 nt, artificial sequence
  Synthetic sequence; sense nucleic acid molecule
cauguuaucuccaaagcca

SEQ ID NO: 1255 - RNA, 19 nt, artificial sequence
  Synthetic sequence; antisense nucleic acid molecule
uggcuuuggagauaacaug

SEQ ID NO: 1256 - RNA, 19 nt, artificial sequence
  Synthetic sequence; sense nucleic acid molecule
auguuaucuccaaagccac

SEQ ID NO: 1257 - RNA, 19 nt, artificial sequence
  Synthetic sequence; antisense nucleic acid molecule
guggcuuuggagauaacau

SEQ ID NO: 1258 - RNA, 19 nt, artificial sequence
  Synthetic sequence; sense nucleic acid molecule
aucuccaaagccacagaag

SEQ ID NO: 1259 - RNA, 19 nt, artificial sequence
  Synthetic sequence; antisense nucleic acid molecule
cuucuguggcuuuggagau

SEQ ID NO: 1260 - RNA, 19 nt, artificial sequence
  Synthetic sequence; sense nucleic acid molecule
cuccaaagccacagaagaa

SEQ ID NO: 1261 - RNA, 19 nt, artificial sequence
  Synthetic sequence; antisense nucleic acid molecule
uucuucuguggcuuuggag

SEQ ID NO: 1262 - RNA, 19 nt, artificial sequence
  Synthetic sequence; sense nucleic acid molecule
aaauuuguggaccaggcuu

SEQ ID NO: 1263 - RNA, 19 nt, artificial sequence
  Synthetic sequence; antisense nucleic acid molecule
aagccugguccacaaauuu

SEQ ID NO: 1264 - RNA, 19 nt, artificial sequence
  Synthetic sequence; sense nucleic acid molecule
auuuguggaccaggcuugu

SEQ ID NO: 1265 - RNA, 19 nt, artificial sequence
  Synthetic sequence; antisense nucleic acid molecule
acaagccugguccacaaau

SEQ ID NO: 1266 - RNA, 19 nt, artificial sequence
  Synthetic sequence; sense nucleic acid molecule
uuguggaccaggcuugugg

SEQ ID NO: 1267 - RNA, 19 nt, artificial sequence
  Synthetic sequence; antisense nucleic acid molecule
ccacaagccugguccacaa

SEQ ID NO: 1268 - RNA, 19 nt, artificial sequence
  Synthetic sequence; sense nucleic acid molecule
uguggaccaggcuuguggc

SEQ ID NO: 1269 - RNA, 19 nt, artificial sequence
  Synthetic sequence; antisense nucleic acid molecule
gccacaagccugguccaca

SEQ ID NO: 1270 - RNA, 19 nt, artificial sequence
  Synthetic sequence; sense nucleic acid molecule
gaccaggcuuguggcccaa

SEQ ID NO: 1271 - RNA, 19 nt, artificial sequence
  Synthetic sequence; antisense nucleic acid molecule
uugggccacaagccugguc

SEQ ID NO: 1272 - RNA, 19 nt, artificial sequence
  Synthetic sequence; sense nucleic acid molecule
uuguggcccaagucauuca

SEQ ID NO: 1273 - RNA, 19 nt, artificial sequence
  Synthetic sequence; antisense nucleic acid molecule
ugaaugacuugggccacaa

SEQ ID NO: 1274 - RNA, 19 nt, artificial sequence
  Synthetic sequence; sense nucleic acid molecule
uguggcccaagucauucaa

SEQ ID NO: 1275 - RNA, 19 nt, artificial sequence
  Synthetic sequence; antisense nucleic acid molecule
uugaaugacuugggccaca

SEQ ID NO: 1276 - RNA, 19 nt, artificial sequence
  Synthetic sequence; sense nucleic acid molecule
guggcccaagucauucaaa

SEQ ID NO: 1277 - RNA, 19 nt, artificial sequence
  Synthetic sequence; antisense nucleic acid molecule
uuugaaugacuugggccac

SEQ ID NO: 1278 - RNA, 19 nt, artificial sequence
  Synthetic sequence; sense nucleic acid molecule
gcccaagucauucaaaaga

SEQ ID NO: 1279 - RNA, 19 nt, artificial sequence
  Synthetic sequence; antisense nucleic acid molecule
ucuuuugaaugacuugggc

SEQ ID NO: 1280 - RNA, 19 nt, artificial sequence
  Synthetic sequence; sense nucleic acid molecule
aaaguauggugagucccaa

SEQ ID NO: 1281 - RNA, 19 nt, artificial sequence
  Synthetic sequence; antisense nucleic acid molecule
uugggacucaccauacuuu

SEQ ID NO: 1282 - RNA, 19 nt, artificial sequence
  Synthetic sequence; sense nucleic acid molecule
aguauggugagucccaaga

SEQ ID NO: 1283 - RNA, 19 nt, artificial sequence
  Synthetic sequence; antisense nucleic acid molecule
ucuugggacucaccauacu

SEQ ID NO: 1284 - RNA, 19 nt, artificial sequence
  Synthetic sequence; sense nucleic acid molecule
guauggugagucccaagau

SEQ ID NO: 1285 - RNA, 19 nt, artificial sequence
  Synthetic sequence; antisense nucleic acid molecule
aucuugggacucaccauac

SEQ ID NO: 1286 - RNA, 19 nt, artificial sequence
  Synthetic sequence; sense nucleic acid molecule
uauggugagucccaagauc

SEQ ID NO: 1287 - RNA, 19 nt, artificial sequence
  Synthetic sequence; antisense nucleic acid molecule
gaucuugggacucaccaua

SEQ ID NO: 1288 - RNA, 19 nt, artificial sequence
  Synthetic sequence; sense nucleic acid molecule
ggugagucccaagaucucu

SEQ ID NO: 1289 - RNA, 19 nt, artificial sequence
  Synthetic sequence; antisense nucleic acid molecule
agagaucuugggacucacc

SEQ ID NO: 1290 - RNA, 19 nt, artificial sequence
  Synthetic sequence; sense nucleic acid molecule
gugagucccaagaucucug

SEQ ID NO: 1291 - RNA, 19 nt, artificial sequence
  Synthetic sequence; antisense nucleic acid molecule
cagagaucuugggacucac

SEQ ID NO: 1292 - RNA, 19 nt, artificial sequence
  Synthetic sequence; sense nucleic acid molecule
aucucugcuggacaucaac

SEQ ID NO: 1293 - RNA, 19 nt, artificial sequence
  Synthetic sequence; antisense nucleic acid molecule
guugauguccagcagagau

SEQ ID NO: 1294 - RNA, 19 nt, artificial sequence
  Synthetic sequence; sense nucleic acid molecule
uguggucagagcagcucga

SEQ ID NO: 1295 - RNA, 19 nt, artificial sequence
  Synthetic sequence; antisense nucleic acid molecule
ucgagcugcucugaccaca

SEQ ID NO: 1296 - RNA, 19 nt, artificial sequence
  Synthetic sequence; sense nucleic acid molecule
guggucagagcagcucgac

SEQ ID NO: 1297 - RNA, 19 nt, artificial sequence
  Synthetic sequence; antisense nucleic acid molecule
gucgagcugcucugaccac

SEQ ID NO: 1298 - RNA, 19 nt, artificial sequence
  Synthetic sequence; sense nucleic acid molecule
aaccuuacuacagcaucua

SEQ ID NO: 1299 - RNA, 19 nt, artificial sequence
  Synthetic sequence; antisense nucleic acid molecule
uagaugcuguaguaagguu

SEQ ID NO: 1300 - RNA, 19 nt, artificial sequence
  Synthetic sequence; sense nucleic acid molecule
accuuacuacagcaucuau

SEQ ID NO: 1301 - RNA, 19 nt, artificial sequence
  Synthetic sequence; antisense nucleic acid molecule
auagaugcuguaguaaggu

SEQ ID NO: 1302 - RNA, 19 nt, artificial sequence
  Synthetic sequence; sense nucleic acid molecule
ccuuacuacagcaucuaua

SEQ ID NO: 1303 - RNA, 19 nt, artificial sequence
  Synthetic sequence; antisense nucleic acid molecule
uauagaugcuguaguaagg

SEQ ID NO: 1304 - RNA, 19 nt, artificial sequence
  Synthetic sequence; sense nucleic acid molecule
cuuacuacagcaucuauaa

SEQ ID NO: 1305 - RNA, 19 nt, artificial sequence
  Synthetic sequence; antisense nucleic acid molecule
uuauagaugcuguaguaag

SEQ ID NO: 1306 - RNA, 19 nt, artificial sequence
  Synthetic sequence; sense nucleic acid molecule
gagcagcccauguaacuua

SEQ ID NO: 1307 - RNA, 19 nt, artificial sequence
  Synthetic sequence; antisense nucleic acid molecule
uaaguuacaugggcugcuc

SEQ ID NO: 1308 - RNA, 19 nt, artificial sequence
  Synthetic sequence; sense nucleic acid molecule
agcagcccauguaacuuac

SEQ ID NO: 1309 - RNA, 19 nt, artificial sequence
  Synthetic sequence; antisense nucleic acid molecule
guaaguuacaugggcugcu

SEQ ID NO: 1310 - RNA, 19 nt, artificial sequence
  Synthetic sequence; sense nucleic acid molecule
uggauuugccaauucauau

SEQ ID NO: 1311 - RNA, 19 nt, artificial sequence
  Synthetic sequence; antisense nucleic acid molecule
auaugaauuggcaaaucca

SEQ ID NO: 1312 - RNA, 19 nt, artificial sequence
  Synthetic sequence; sense nucleic acid molecule
ggauuugccaauucauaua

SEQ ID NO: 1313 - RNA, 19 nt, artificial sequence
  Synthetic sequence; antisense nucleic acid molecule
uauaugaauuggcaaaucc

SEQ ID NO: 1314 - RNA, 19 nt, artificial sequence
  Synthetic sequence; sense nucleic acid molecule
auucauauauugccaugca

SEQ ID NO: 1315 - RNA, 19 nt, artificial sequence
  Synthetic sequence; antisense nucleic acid molecule
ugcauggcaauauaugaau

SEQ ID NO: 1316 - RNA, 19 nt, artificial sequence
  Synthetic sequence; sense nucleic acid molecule
uucauauauugccaugcau

SEQ ID NO: 1317 - RNA, 19 nt, artificial sequence
  Synthetic sequence; antisense nucleic acid molecule
augcauggcaauauaugaa

SEQ ID NO: 1318 - RNA, 19 nt, artificial sequence
  Synthetic sequence; sense nucleic acid molecule
ucauauauugccaugcauu

SEQ ID NO: 1319 - RNA, 19 nt, artificial sequence
  Synthetic sequence; antisense nucleic acid molecule
aaugcauggcaauauauga

SEQ ID NO: 1320 - RNA, 19 nt, artificial sequence
  Synthetic sequence; sense nucleic acid molecule
auauugccaugcauuauca

SEQ ID NO: 1321 - RNA, 19 nt, artificial sequence
  Synthetic sequence; antisense nucleic acid molecule
ugauaaugcauggcaauau

SEQ ID NO: 1322 - RNA, 19 nt, artificial sequence
  Synthetic sequence; sense nucleic acid molecule
uauugccaugcauuaucac

SEQ ID NO: 1323 - RNA, 19 nt, artificial sequence
  Synthetic sequence; antisense nucleic acid molecule
gugauaaugcauggcaaua

SEQ ID NO: 1324 - RNA, 19 nt, artificial sequence
  Synthetic sequence; sense nucleic acid molecule
auugccaugcauuaucaca

SEQ ID NO: 1325 - RNA, 19 nt, artificial sequence
  Synthetic sequence; antisense nucleic acid molecule
ugugauaaugcauggcaau

SEQ ID NO: 1326 - RNA, 19 nt, artificial sequence
  Synthetic sequence; sense nucleic acid molecule
uugccaugcauuaucacac

SEQ ID NO: 1327 - RNA, 19 nt, artificial sequence
  Synthetic sequence; antisense nucleic acid molecule
gugugauaaugcauggcaa

SEQ ID NO: 1328 - RNA, 19 nt, artificial sequence
  Synthetic sequence; sense nucleic acid molecule
uuaucacaccacuaaugac

SEQ ID NO: 1329 - RNA, 19 nt, artificial sequence
  Synthetic sequence; antisense nucleic acid molecule
gucauuaguggugugauaa

SEQ ID NO: 1330 - RNA, 19 nt, artificial sequence
  Synthetic sequence; sense nucleic acid molecule
uaucacaccacuaaugacu

SEQ ID NO: 1331 - RNA, 19 nt, artificial sequence
  Synthetic sequence; antisense nucleic acid molecule
agucauuaguggugugaua

SEQ ID NO: 1332 - RNA, 19 nt, artificial sequence
  Synthetic sequence; sense nucleic acid molecule
aucacaccacuaaugacuu

SEQ ID NO: 1333 - RNA, 19 nt, artificial sequence
  Synthetic sequence; antisense nucleic acid molecule
aagucauuaguggugugau

SEQ ID NO: 1334 - RNA, 19 nt, artificial sequence
  Synthetic sequence; sense nucleic acid molecule
ucacaccacuaaugacuua

SEQ ID NO: 1335 - RNA, 19 nt, artificial sequence
  Synthetic sequence; antisense nucleic acid molecule
uaagucauuagugguguga

SEQ ID NO: 1336 - RNA, 19 nt, artificial sequence
  Synthetic sequence; sense nucleic acid molecule
uaaugacuuagugcaggaa

SEQ ID NO: 1337 - RNA, 19 nt, artificial sequence
  Synthetic sequence; antisense nucleic acid molecule
uuccugcacuaagucauua

SEQ ID NO: 1338 - RNA, 19 nt, artificial sequence
  Synthetic sequence; sense nucleic acid molecule
aaugacuuagugcaggaau

SEQ ID NO: 1339 - RNA, 19 nt, artificial sequence
  Synthetic sequence; antisense nucleic acid molecule
auuccugcacuaagucauu

SEQ ID NO: 1340 - RNA, 19 nt, artificial sequence
  Synthetic sequence; sense nucleic acid molecule
augacuuagugcaggaaua

SEQ ID NO: 1341 - RNA, 19 nt, artificial sequence
  Synthetic sequence; antisense nucleic acid molecule
uauuccugcacuaagucau

SEQ ID NO: 1342 - RNA, 19 nt, artificial sequence
  Synthetic sequence; sense nucleic acid molecule
ugacuuagugcaggaauau

SEQ ID NO: 1343 - RNA, 19 nt, artificial sequence
  Synthetic sequence; antisense nucleic acid molecule
auauuccugcacuaaguca

SEQ ID NO: 1344 - RNA, 19 nt, artificial sequence
  Synthetic sequence; sense nucleic acid molecule
gacuuagugcaggaauaug

SEQ ID NO: 1345 - RNA, 19 nt, artificial sequence
  Synthetic sequence; antisense nucleic acid molecule
cauauuccugcacuaaguc

SEQ ID NO: 1346 - RNA, 19 nt, artificial sequence
  Synthetic sequence; sense nucleic acid molecule
acuuagugcaggaauauga

SEQ ID NO: 1347 - RNA, 19 nt, artificial sequence
  Synthetic sequence; antisense nucleic acid molecule
ucauauuccugcacuaagu

SEQ ID NO: 1348 - RNA, 19 nt, artificial sequence
  Synthetic sequence; sense nucleic acid molecule
cuuagugcaggaauaugac

SEQ ID NO: 1349 - RNA, 19 nt, artificial sequence
  Synthetic sequence; antisense nucleic acid molecule
gucauauuccugcacuaag

SEQ ID NO: 1350 - RNA, 19 nt, artificial sequence
  Synthetic sequence; sense nucleic acid molecule
uuagugcaggaauaugaca

SEQ ID NO: 1351 - RNA, 19 nt, artificial sequence
  Synthetic sequence; antisense nucleic acid molecule
ugucauauuccugcacuaa

SEQ ID NO: 1352 - RNA, 19 nt, artificial sequence
  Synthetic sequence; sense nucleic acid molecule
uagugcaggaauaugacag

SEQ ID NO: 1353 - RNA, 19 nt, artificial sequence
  Synthetic sequence; antisense nucleic acid molecule
cugucauauuccugcacua

SEQ ID NO: 1354 - RNA, 19 nt, artificial sequence
  Synthetic sequence; sense nucleic acid molecule
agugcaggaauaugacagc

SEQ ID NO: 1355 - RNA, 19 nt, artificial sequence
  Synthetic sequence; antisense nucleic acid molecule
gcugucauauuccugcacu

SEQ ID NO: 1356 - RNA, 19 nt, artificial sequence
  Synthetic sequence; sense nucleic acid molecule
gugcaggaauaugacagca

SEQ ID NO: 1357 - RNA, 19 nt, artificial sequence
  Synthetic sequence; antisense nucleic acid molecule
ugcugucauauuccugcac

SEQ ID NO: 1358 - RNA, 19 nt, artificial sequence
  Synthetic sequence; sense nucleic acid molecule
ugcaggaauaugacagcac

SEQ ID NO: 1359 - RNA, 19 nt, artificial sequence
  Synthetic sequence; antisense nucleic acid molecule
gugcugucauauuccugca

SEQ ID NO: 1360 - RNA, 19 nt, artificial sequence
  Synthetic sequence; sense nucleic acid molecule
gaauaugacagcacuucag

SEQ ID NO: 1361 - RNA, 19 nt, artificial sequence
  Synthetic sequence; antisense nucleic acid molecule
cugaagugcugucauauuc

SEQ ID NO: 1362 - RNA, 19 nt, artificial sequence
  Synthetic sequence; sense nucleic acid molecule
aauaugacagcacuucagc

SEQ ID NO: 1363 - RNA, 19 nt, artificial sequence
  Synthetic sequence; antisense nucleic acid molecule
gcugaagugcugucauauu

SEQ ID NO: 1364 - RNA, 19 nt, artificial sequence
  Synthetic sequence; sense nucleic acid molecule
auaugacagcacuucagcc

SEQ ID NO: 1365 - RNA, 19 nt, artificial sequence
  Synthetic sequence; antisense nucleic acid molecule
ggcugaagugcugucauau

SEQ ID NO: 1366 - RNA, 19 nt, artificial sequence
  Synthetic sequence; sense nucleic acid molecule
gacagcacuucagccaagc

SEQ ID NO: 1367 - RNA, 19 nt, artificial sequence
  Synthetic sequence; antisense nucleic acid molecule
gcuuggcugaagugcuguc

SEQ ID NO: 1368 - RNA, 19 nt, artificial sequence
  Synthetic sequence; sense nucleic acid molecule
acagcacuucagccaagca

SEQ ID NO: 1369 - RNA, 19 nt, artificial sequence
  Synthetic sequence; antisense nucleic acid molecule
ugcuuggcugaagugcugu

SEQ ID NO: 1370 - RNA, 19 nt, artificial sequence
  Synthetic sequence; sense nucleic acid molecule
cacuucagccaagcagauu

SEQ ID NO: 1371 - RNA, 19 nt, artificial sequence
  Synthetic sequence; antisense nucleic acid molecule
aaucugcuuggcugaagug

SEQ ID NO: 1372 - RNA, 19 nt, artificial sequence
  Synthetic sequence; sense nucleic acid molecule
acuucagccaagcagauuc

SEQ ID NO: 1373 - RNA, 19 nt, artificial sequence
  Synthetic sequence; antisense nucleic acid molecule
gaaucugcuuggcugaagu

SEQ ID NO: 1374 - RNA, 19 nt, artificial sequence
  Synthetic sequence; sense nucleic acid molecule
cuucagccaagcagauucc

SEQ ID NO: 1375 - RNA, 19 nt, artificial sequence
  Synthetic sequence; antisense nucleic acid molecule
ggaaucugcuuggcugaag

SEQ ID NO: 1376 - RNA, 19 nt, artificial sequence
  Synthetic sequence; sense nucleic acid molecule
uucagccaagcagauucca

SEQ ID NO: 1377 - RNA, 19 nt, artificial sequence
  Synthetic sequence; antisense nucleic acid molecule
uggaaucugcuuggcugaa

SEQ ID NO: 1378 - RNA, 19 nt, artificial sequence
  Synthetic sequence; sense nucleic acid molecule
ucagccaagcagauuccag

SEQ ID NO: 1379 - RNA, 19 nt, artificial sequence
  Synthetic sequence; antisense nucleic acid molecule
cuggaaucugcuuggcuga

SEQ ID NO: 1380 - RNA, 19 nt, artificial sequence
  Synthetic sequence; sense nucleic acid molecule
cagccaagcagauuccagu

SEQ ID NO: 1381 - RNA, 19 nt, artificial sequence
  Synthetic sequence; antisense nucleic acid molecule
acuggaaucugcuuggcug

SEQ ID NO: 1382 - RNA, 19 nt, artificial sequence
  Synthetic sequence; sense nucleic acid molecule
ccaagcagauuccaguccc

SEQ ID NO: 1383 - RNA, 19 nt, artificial sequence
  Synthetic sequence; antisense nucleic acid molecule
gggacuggaaucugcuugg

SEQ ID NO: 1384 - RNA, 19 nt, artificial sequence
  Synthetic sequence; sense nucleic acid molecule
cccuccguuuaaagucaug

SEQ ID NO: 1385 - RNA, 19 nt, artificial sequence
  Synthetic sequence; antisense nucleic acid molecule
caugacuuuaaacggaggg

SEQ ID NO: 1386 - RNA, 19 nt, artificial sequence
  Synthetic sequence; sense nucleic acid molecule
ccuccguuuaaagucaugg

SEQ ID NO: 1387 - RNA, 19 nt, artificial sequence
  Synthetic sequence; antisense nucleic acid molecule
ccaugacuuuaaacggagg

SEQ ID NO: 1388 - RNA, 19 nt, artificial sequence
  Synthetic sequence; sense nucleic acid molecule
cuccguuuaaagucaugga

SEQ ID NO: 1389 - RNA, 19 nt, artificial sequence
  Synthetic sequence; antisense nucleic acid molecule
uccaugacuuuaaacggag

SEQ ID NO: 1390 - RNA, 19 nt, artificial sequence
  Synthetic sequence; sense nucleic acid molecule
guuuaaagucauggaggcu

SEQ ID NO: 1391 - RNA, 19 nt, artificial sequence
  Synthetic sequence; antisense nucleic acid molecule
agccuccaugacuuuaaac

SEQ ID NO: 1392 - RNA, 19 nt, artificial sequence
  Synthetic sequence; sense nucleic acid molecule
uuuaaagucauggaggcua

SEQ ID NO: 1393 - RNA, 19 nt, artificial sequence
  Synthetic sequence; antisense nucleic acid molecule
uagccuccaugacuuuaaa

SEQ ID NO: 1394 - RNA, 19 nt, artificial sequence
  Synthetic sequence; sense nucleic acid molecule
uuaaagucauggaggcuau

SEQ ID NO: 1395 - RNA, 19 nt, artificial sequence
  Synthetic sequence; antisense nucleic acid molecule
auagccuccaugacuuuaa

SEQ ID NO: 1396 - RNA, 19 nt, artificial sequence
  Synthetic sequence; sense nucleic acid molecule
uaaagucauggaggcuaua

SEQ ID NO: 1397 - RNA, 19 nt, artificial sequence
  Synthetic sequence; antisense nucleic acid molecule
uauagccuccaugacuuua

SEQ ID NO: 1398 - RNA, 19 nt, artificial sequence
  Synthetic sequence; sense nucleic acid molecule
aaagucauggaggcuauag

SEQ ID NO: 1399 - RNA, 19 nt, artificial sequence
  Synthetic sequence; antisense nucleic acid molecule
cuauagccuccaugacuuu

SEQ ID NO: 1400 - RNA, 19 nt, artificial sequence
  Synthetic sequence; sense nucleic acid molecule
aagucauggaggcuauagg

SEQ ID NO: 1401 - RNA, 19 nt, artificial sequence
  Synthetic sequence; antisense nucleic acid molecule
ccuauagccuccaugacuu

SEQ ID NO: 1402 - RNA, 19 nt, artificial sequence
  Synthetic sequence; sense nucleic acid molecule
cauggaggcuauaggaucu

SEQ ID NO: 1403 - RNA, 19 nt, artificial sequence
  Synthetic sequence; antisense nucleic acid molecule
agauccuauagccuccaug

SEQ ID NO: 1404 - RNA, 19 nt, artificial sequence
  Synthetic sequence; sense nucleic acid molecule
auggaggcuauaggaucuu

SEQ ID NO: 1405 - RNA, 19 nt, artificial sequence
  Synthetic sequence; antisense nucleic acid molecule
aagauccuauagccuccau

SEQ ID NO: 1406 - RNA, 19 nt, artificial sequence
  Synthetic sequence; sense nucleic acid molecule
uggaggcuauaggaucuua

SEQ ID NO: 1407 - RNA, 19 nt, artificial sequence
  Synthetic sequence; antisense nucleic acid molecule
uaagauccuauagccucca

SEQ ID NO: 1408 - RNA, 19 nt, artificial sequence
  Synthetic sequence; sense nucleic acid molecule
ggaggcuauaggaucuuau

SEQ ID NO: 1409 - RNA, 19 nt, artificial sequence
  Synthetic sequence; antisense nucleic acid molecule
auaagauccuauagccucc

SEQ ID NO: 1410 - RNA, 19 nt, artificial sequence
  Synthetic sequence; sense nucleic acid molecule
gaggcuauaggaucuuaug

SEQ ID NO: 1411 - RNA, 19 nt, artificial sequence
  Synthetic sequence; antisense nucleic acid molecule
cauaagauccuauagccuc

SEQ ID NO: 1412 - RNA, 19 nt, artificial sequence
  Synthetic sequence; sense nucleic acid molecule
aggcuauaggaucuuaugu

SEQ ID NO: 1413 - RNA, 19 nt, artificial sequence
  Synthetic sequence; antisense nucleic acid molecule
acauaagauccuauagccu

SEQ ID NO: 1414 - RNA, 19 nt, artificial sequence
  Synthetic sequence; sense nucleic acid molecule
ggcuauaggaucuuaugua

SEQ ID NO: 1415 - RNA, 19 nt, artificial sequence
  Synthetic sequence; antisense nucleic acid molecule
uacauaagauccuauagcc

SEQ ID NO: 1416 - RNA, 19 nt, artificial sequence
  Synthetic sequence; sense nucleic acid molecule
gcuauaggaucuuauguaa

SEQ ID NO: 1417 - RNA, 19 nt, artificial sequence
  Synthetic sequence; antisense nucleic acid molecule
uuacauaagauccuauagc

SEQ ID NO: 1418 - RNA, 19 nt, artificial sequence
  Synthetic sequence; sense nucleic acid molecule
uggacuuuauucuaacuug

SEQ ID NO: 1419 - RNA, 19 nt, artificial sequence
  Synthetic sequence; antisense nucleic acid molecule
caaguuagaauaaagucca

SEQ ID NO: 1420 - RNA, 19 nt, artificial sequence
  Synthetic sequence; sense nucleic acid molecule
aaaaguuggcaguuauggu

SEQ ID NO: 1421 - RNA, 19 nt, artificial sequence
  Synthetic sequence; antisense nucleic acid molecule
accauaacugccaacuuuu

SEQ ID NO: 1422 - RNA, 19 nt, artificial sequence
  Synthetic sequence; sense nucleic acid molecule
aaaguuggcaguuaugguu

SEQ ID NO: 1423 - RNA, 19 nt, artificial sequence
  Synthetic sequence; antisense nucleic acid molecule
aaccauaacugccaacuuu

SEQ ID NO: 1424 - RNA, 19 nt, artificial sequence
  Synthetic sequence; sense nucleic acid molecule
aaguuggcaguuaugguuu

SEQ ID NO: 1425 - RNA, 19 nt, artificial sequence
  Synthetic sequence; antisense nucleic acid molecule
aaaccauaacugccaacuu

SEQ ID NO: 1426 - RNA, 19 nt, artificial sequence
  Synthetic sequence; sense nucleic acid molecule
aguuggcaguuaugguuuu

SEQ ID NO: 1427 - RNA, 19 nt, artificial sequence
  Synthetic sequence; antisense nucleic acid molecule
aaaaccauaacugccaacu

SEQ ID NO: 1428 - RNA, 19 nt, artificial sequence
  Synthetic sequence; sense nucleic acid molecule
guuggcaguuaugguuuuc

SEQ ID NO: 1429 - RNA, 19 nt, artificial sequence
  Synthetic sequence; antisense nucleic acid molecule
gaaaaccauaacugccaac

SEQ ID NO: 1430 - RNA, 19 nt, artificial sequence
  Synthetic sequence; sense nucleic acid molecule
uuggcaguuaugguuuucu

SEQ ID NO: 1431 - RNA, 19 nt, artificial sequence
  Synthetic sequence; antisense nucleic acid molecule
agaaaaccauaacugccaa

SEQ ID NO: 1432 - RNA, 19 nt, artificial sequence
  Synthetic sequence; sense nucleic acid molecule
uaugguuuucuuucaucug

SEQ ID NO: 1433 - RNA, 19 nt, artificial sequence
  Synthetic sequence; antisense nucleic acid molecule
cagaugaaagaaaaccaua

SEQ ID NO: 1434 - RNA, 19 nt, artificial sequence
  Synthetic sequence; sense nucleic acid molecule
ugguuuucuuucaucugau

SEQ ID NO: 1435 - RNA, 19 nt, artificial sequence
  Synthetic sequence; antisense nucleic acid molecule
aucagaugaaagaaaacca

SEQ ID NO: 1436 - RNA, 19 nt, artificial sequence
  Synthetic sequence; sense nucleic acid molecule
gguuuucuuucaucugaug

SEQ ID NO: 1437 - RNA, 19 nt, artificial sequence
  Synthetic sequence; antisense nucleic acid molecule
caucagaugaaagaaaacc

SEQ ID NO: 1438 - RNA, 19 nt, artificial sequence
  Synthetic sequence; sense nucleic acid molecule
uuucuuucaucugaugugu

SEQ ID NO: 1439 - RNA, 19 nt, artificial sequence
  Synthetic sequence; antisense nucleic acid molecule
acacaucagaugaaagaaa

SEQ ID NO: 1440 - RNA, 19 nt, artificial sequence
  Synthetic sequence; sense nucleic acid molecule
uucuuucaucugauguguc

SEQ ID NO: 1441 - RNA, 19 nt, artificial sequence
  Synthetic sequence; antisense nucleic acid molecule
gacacaucagaugaaagaa

SEQ ID NO: 1442 - RNA, 19 nt, artificial sequence
  Synthetic sequence; sense nucleic acid molecule
cuguugauuugcuuuguag

SEQ ID NO: 1443 - RNA, 19 nt, artificial sequence
  Synthetic sequence; antisense nucleic acid molecule
cuacaaagcaaaucaacag

SEQ ID NO: 1444 - RNA, 19 nt, artificial sequence
  Synthetic sequence; sense nucleic acid molecule
uguugauuugcuuuguagu

SEQ ID NO: 1445 - RNA, 19 nt, artificial sequence
  Synthetic sequence; antisense nucleic acid molecule
acuacaaagcaaaucaaca

SEQ ID NO: 1446 - RNA, 19 nt, artificial sequence
  Synthetic sequence; sense nucleic acid molecule
guugauuugcuuuguaguu

SEQ ID NO: 1447 - RNA, 19 nt, artificial sequence
  Synthetic sequence; antisense nucleic acid molecule
aacuacaaagcaaaucaac

SEQ ID NO: 1448 - RNA, 19 nt, artificial sequence
  Synthetic sequence; sense nucleic acid molecule
ugauuugcuuuguaguuug

SEQ ID NO: 1449 - RNA, 19 nt, artificial sequence
  Synthetic sequence; antisense nucleic acid molecule
caaacuacaaagcaaauca

SEQ ID NO: 1450 - RNA, 19 nt, artificial sequence
  Synthetic sequence; sense nucleic acid molecule
cuuuguaguuuguugacau

SEQ ID NO: 1451 - RNA, 19 nt, artificial sequence
  Synthetic sequence; antisense nucleic acid molecule
augucaacaaacuacaaag

SEQ ID NO: 1452 - RNA, 19 nt, artificial sequence
  Synthetic sequence; sense nucleic acid molecule
guaguuuguugacaucuua

SEQ ID NO: 1453 - RNA, 19 nt, artificial sequence
  Synthetic sequence; antisense nucleic acid molecule
uaagaugucaacaaacuac

SEQ ID NO: 1454 - RNA, 19 nt, artificial sequence
  Synthetic sequence; sense nucleic acid molecule
aguuuguugacaucuuaag

SEQ ID NO: 1455 - RNA, 19 nt, artificial sequence
  Synthetic sequence; antisense nucleic acid molecule
cuuaagaugucaacaaacu

SEQ ID NO: 1456 - RNA, 19 nt, artificial sequence
  Synthetic sequence; sense nucleic acid molecule
guuuguugacaucuuaaga

SEQ ID NO: 1457 - RNA, 19 nt, artificial sequence
  Synthetic sequence; antisense nucleic acid molecule
ucuuaagaugucaacaaac

SEQ ID NO: 1458 - DNA, 20 bp, artificial sequence
  Synthetic sequence; forward primer
gcttgtggcccaagtcattc

SEQ ID NO: 1459 - DNA, 20 bp, artificial sequence
  Synthetic sequence; reverse primer
gagtgttgatgggggtcgag

SEQ ID NO: 1460 - DNA, 22 bp, artificial sequence
  Synthetic sequence; forward primer
caccattggcaatgagcggttc

SEQ ID NO: 1461 - DNA, 22 bp, artificial sequence
  Synthetic sequence; reverse primer
aggtctttgcggatgtccacgt

What is claimed is:

1. A method of treating an obese subject with a therapeutic agent that treats or inhibits obesity, the method comprising the steps of:
   a) determining whether the subject has a G-Protein Coupled Receptor 75 (GPR75) missense variant nucleic acid molecule encoding a predicted loss-of-function GPR75 polypeptide by:
      i) obtaining or having obtained a biological sample from the subject; and
      ii) performing or having performed a sequence analysis on the biological sample to determine if the subject has a genotype comprising the GPR75 missense variant nucleic acid molecule; wherein the presence of a homozygous genotype having the GPR75 missense variant nucleic acid molecule encoding a predicted loss-of-function GPR75 polypeptide indicates the subject has a reduced risk of developing obesity; and
   b) when the subject does not have a G-Protein Coupled Receptor 75 (GPR75) missense variant nucleic acid molecule encoding a predicted loss-of-function GPR75 polypeptide (GPR75 reference), then administering or continuing to administer a therapeutic agent that treats or inhibits obesity and/or a GPR75 inhibitor and/or an inhibitor of nucleic acid encoding GPR75 expression in a standard dosage amount to said subject; or
   c) when the subject is heterozygous for a GPR75 missense variant nucleic acid molecule encoding a predicted loss-of-function GPR75 polypeptide, then administering or continuing to administer a therapeutic agent that treats or inhibits obesity and/or a GPR75 inhibitor and/or an inhibitor of nucleic acid encoding GPR75 expression in an amount that is the same as or lower than a standard dosage amount to said subject;
   wherein the obesity in said subject is treated.

2. The method according to claim 1, wherein the subject is GPR75 reference, and the subject is administered a therapeutic agent that treats or inhibits obesity and/or a GPR75 inhibitor in a standard dosage amount.

3. The method according to claim 1, wherein the subject is heterozygous for a GPR75 missense variant nucleic acid molecule, and the subject is administered a therapeutic agent that treats or inhibits obesity and/or a GPR75 inhibitor in an amount that is the same as or lower than a standard dosage amount.

4. The method according to claim 1, wherein the GPR75 missense variant nucleic acid molecule is a nucleic acid molecule encoding loss of function GPR75 polypeptide mutation Ala110fs (SEQ ID NO: 56), Ala116Thr (SEQ ID NO: 57), Gln234Stop (SEQ ID NO: 59), Arg236fs (SEQ ID NO: 60), Cys400fs (SEQ ID NO: 108), or Tyr207Cys (SEQ ID NO: 58).

5. The method according to claim 4, wherein the GPR75 missense variant nucleic acid molecule encodes mutation:

Ala110fs and
   i) the genomic nucleic acid molecule having a nucleotide sequence lacking a CCAGTAG heptanucleotide at positions corresponding to positions 5,540-5,546 according to SEQ ID NO: 1;
   ii) the mRNA molecule having a nucleotide sequence lacking a CCAGUAG heptanucleotide at positions corresponding to positions 539-545 according to SEQ ID NO: 7, lacking a CCAGUAG heptanucleotide at positions corresponding to positions 440-446 according to SEQ ID NO: 8, lacking a CCAGUAG heptanucleotide at positions corresponding to positions 361-367 according to SEQ ID NO: 9, lacking a CCAGUAG heptanucleotide at positions corresponding to positions 600-606 according to SEQ ID NO: 10, and
   iii) a cDNA molecule produced from an mRNA molecule, wherein the cDNA molecule has a nucleotide sequence lacking a CCAGTAG heptanucleotide at positions corresponding to positions 539-545 according to SEQ ID NO: 31, lacking a CCAGTAG heptanucleotide at positions corresponding to positions 440-446 according to SEQ ID NO: 32, lacking a CCAGTAG heptanucleotide at positions corresponding to positions 361-367 according to SEQ ID NO: 33, lacking a CCAGTAG heptanucleotide at positions corresponding to positions 600-606 according to SEQ ID NO: 34;

Ala116Thr and
   i) the genomic nucleic acid molecule comprising an adenine at a position corresponding to position 5,557 according to SEQ ID NO: 3;
   ii) the mRNA molecule having a nucleotide sequence comprising an adenine at a position corresponding to position 556 according to SEQ ID NO: 12, comprising an adenine at a position corresponding to position 457 according to SEQ ID NO: 17, comprising an adenine at a position corresponding to position 378 according to SEQ ID NO: 22, comprising an adenine at a position corresponding to position 617 according to SEQ ID NO: 27, and
   iii) a cDNA molecule produced from an mRNA molecule, wherein the cDNA molecule has a nucleotide sequence comprising an adenine at a position corresponding to position 556 according to SEQ ID NO: 36, comprising an adenine at a position corresponding to position 457 according to SEQ ID NO: 41, comprising an adenine at a position corresponding to position 378 according to SEQ ID NO: 46, comprising an adenine at a position corresponding to position 617 according to SEQ ID NO: 51;

Gln234Stop and
i) the genomic nucleic acid molecule comprising a thymine at a position corresponding to position 5,911 according to SEQ ID NO: 4;
ii) the mRNA molecule having a nucleotide sequence comprising a uracil at a position corresponding to position 910 according to SEQ ID NO: 13, comprising a uracil at a position corresponding to position 811 according to SEQ ID NO: 18, comprising a uracil at a position corresponding to position 732 according to SEQ ID NO: 23, comprising a uracil at a position corresponding to position 971 according to SEQ ID NO: 28, and
iii) a cDNA molecule produced from an mRNA molecule, wherein the cDNA molecule has a nucleotide sequence comprising a thymine at a position corresponding to position 910 according to SEQ ID NO: 37, comprising a thymine at a position corresponding to position 811 according to SEQ ID NO: 42, comprising a thymine at a position corresponding to position 732 according to SEQ ID NO: 47, comprising a thymine at a position corresponding to position 971 according to SEQ ID NO: 52;

Arg236fs and
i) the genomic nucleic acid molecule lacking an AAAG tetranucleotide at positions corresponding to positions 5,920-5,923 according to SEQ ID NO: 1,
ii) the mRNA molecule having a nucleotide sequence lacking an AAAG tetranucleotide at positions corresponding to positions 919-922 according to SEQ ID NO: 7, lacking an AAAG tetranucleotide at positions corresponding to positions 820-823 according to SEQ ID NO: 8, lacking an AAAG tetranucleotide at positions corresponding to positions 741-744 according to SEQ ID NO: 9, lacking an AAAG tetranucleotide at positions corresponding to positions 980-983 according to SEQ ID NO: 10, and
iii) a cDNA molecule produced from an mRNA molecule, wherein the cDNA molecule has a nucleotide sequence lacking an AAAG tetranucleotide at positions corresponding to positions 919-922 according to SEQ ID NO: 31, lacking an AAAG tetranucleotide at positions corresponding to positions 820-823 according to SEQ ID NO: 32, lacking an AAAG tetranucleotide at positions corresponding to positions 741-744 according to SEQ ID NO: 33, lacking an AAAG tetranucleotide at positions corresponding to positions 980-983 according to SEQ ID NO: 34;

Cys400fs and
i) the genomic nucleic acid molecule comprising an insertion of a thymine at a position corresponding to position 6,411 according to SEQ ID NO: 6;
ii) the mRNA molecule having a nucleotide sequence comprising an insertion of a uracil at a position corresponding to position 1,410 according to SEQ ID NO: 15, comprising an insertion of a uracil at a position corresponding to position 1,311 according to SEQ ID NO: 20, comprising an insertion of a uracil at a position corresponding to position 1,232 according to SEQ ID NO: 25, or comprising an insertion of a uracil at a position corresponding to position 1,471 according to SEQ ID NO: 30, and
iii) a cDNA molecule produced from an mRNA molecule, wherein the cDNA molecule has a nucleotide sequence comprising an insertion of a thymine at a position corresponding to position 1,410 according to SEQ ID NO: 39, comprising an insertion of a thymine at a position corresponding to position 1,311 according to SEQ ID NO: 44, comprising an insertion of a thymine at a position corresponding to position 1,232 according to SEQ ID NO: 49, comprising an insertion of a thymine at a position corresponding to position 1,471 according to SEQ ID NO: 54; or Tyr207Cys and
i) the genomic nucleic acid molecule comprising a guanine at a position corresponding to position 5,831 according to SEQ ID NO: 99;
ii) the mRNA molecule having a nucleotide sequence comprising a guanine at a position corresponding to position 830 according to SEQ ID NO: 100, comprising a guanine at a position corresponding to position 731 according to SEQ ID NO: 101, comprising a guanine at a position corresponding to position 652 according to SEQ ID NO: 102, or comprising a guanine at a position corresponding to position 891 according to SEQ ID NO: 103, and
iii) a cDNA molecule produced from an mRNA molecule, wherein the cDNA molecule has a nucleotide sequence comprising a guanine at a position corresponding to position 830 according to SEQ ID NO: 104, comprising a guanine at a position corresponding to position 731 according to SEQ ID NO: 105, comprising a guanine at a position corresponding to position 652 according to SEQ ID NO: 106, or comprising a guanine at a position corresponding to position 891 according to SEQ ID NO: 107.

6. The method according to claim 4, wherein the sequence analysis comprises sequencing at least a portion of the nucleotide sequence of the GPR75 genomic nucleic acid molecule in the biological sample, wherein the mutation is:

Ala110fs and the sequenced portion comprises a position corresponding to positions 5,540-5,546 according to SEQ ID NO: 2, or the complement thereof; wherein the sequenced portion of the GPR75 genomic nucleic acid molecule in the biological sample is mutated and lacks a CCAGTAG heptanucleotide at positions corresponding to positions 5,540-5,546 according to SEQ ID NO: 1;

Ala116Thr and the sequenced portion comprises a position corresponding to position 5,557 according to SEQ ID NO: 3, or the complement thereof; wherein the sequenced portion of the GPR75 genomic nucleic acid molecule in the biological sample is mutated and comprises an adenine at a position corresponding to position 5,557 according to SEQ ID NO: 3;

Gln234Stop and the sequenced portion comprises a position corresponding to position 5,911 according to SEQ ID NO: 4, or the complement thereof; wherein the sequenced portion of the GPR75 genomic nucleic acid molecule in the biological sample is mutated and comprises a thymine at a position corresponding to position 5,911 according to SEQ ID NO: 4;

Arg236fs and the sequenced portion comprises a position corresponding to positions 5,920-5,923 according to SEQ ID NO: 5, or the complement thereof; wherein the sequenced portion of the GPR75 genomic nucleic acid molecule in the biological sample is mutated and lacks an AAAG tetranucleotide at positions corresponding to positions 5,920-5,923 according to SEQ ID NO: 1;

Cys400fs and the sequenced portion comprises a position corresponding to position 6,411 according to SEQ ID NO: 6, or the complement thereof; wherein the sequenced portion of the GPR75 genomic nucleic acid molecule in the biological sample is mutated and comprises an insertion of a thymine at a position corresponding to position 6,411 according to SEQ ID NO: 6, or Tyr207Cys and the sequenced portion comprises a position corresponding to position 5,831 according to SEQ ID NO: 99, or the complement thereof; wherein the sequenced portion of the GPR75 genomic nucleic acid molecule in the biological sample is mutated and comprises a guanine at a position corresponding to position 5,831 according to SEQ ID NO: 99.

7. The method according to claim 4, wherein the sequence analysis comprises sequencing at least a portion of the nucleotide sequence of the GPR75 mRNA molecule in the biological sample, wherein the sequenced portion comprises a position corresponding to mutation:

Ala110fs and the sequenced portion comprises positions 539-545 according to SEQ ID NO: 11, or the complement thereof; positions 440-446 according to SEQ ID NO: 16, or the complement thereof; positions 361-367 according to SEQ ID NO: 21, or the complement thereof; positions 600-606 according to SEQ ID NO: 26, or the complement thereof, wherein the sequenced portion of the GPR75 mRNA molecule in the biological sample is mutated and lacks a CCAGUAG heptanucleotide at positions corresponding to positions 539-545 according to SEQ ID NO: 7; lacks a CCAGUAG heptanucleotide at positions corresponding to positions 440-446 according to SEQ ID NO: 8; lacks a CCAGUAG heptanucleotide at positions corresponding to positions 361-367 according to SEQ ID NO: 9; lacks a CCAGUAG heptanucleotide at positions corresponding to positions 600-606 according to SEQ ID NO: 10;

Ala116Thr and the sequenced portion comprises position 556 according to SEQ ID NO: 12, or the complement thereof; position 457 according to SEQ ID NO: 17, or the complement thereof; position 378 according to SEQ ID NO: 22, or the complement thereof; position 617 according to SEQ ID NO: 27, or the complement thereof; position 910 according to SEQ ID NO: 13, or the complement thereof, wherein the sequenced portion of the GPR75 mRNA molecule in the biological sample is mutated and comprises an adenine at a position corresponding to position 556 according to SEQ ID NO: 12; comprises an adenine at a position corresponding to position 457 according to SEQ ID NO: 17; comprises an adenine at a position corresponding to position 378 according to SEQ ID NO: 22; comprises an adenine at a position corresponding to position 617 according to SEQ ID NO: 27;

Gln234Stop and the sequenced portion comprises position 910 according to SEQ ID NO: 13, or the complement thereof; position 811 according to SEQ ID NO: 18, or the complement thereof; position 732 according to SEQ ID NO: 23, or the complement thereof; position 971 according to SEQ ID NO: 28, or the complement thereof, wherein the sequenced portion of the GPR75 mRNA molecule in the biological sample is mutated and comprises a uracil at a position corresponding to position 910 according to SEQ ID NO: 13; comprises a uracil at a position corresponding to position 811 according to SEQ ID NO: 18; comprises a uracil at a position corresponding to position 732 according to SEQ ID NO: 23; comprises a uracil at a position corresponding to position 971 according to SEQ ID NO: 28;

Arg236fs and the sequenced portion comprises positions 919-922 according to SEQ ID NO: 14, or the complement thereof; positions 820-823 according to SEQ ID NO: 19, or the complement thereof; positions 741-744 according to SEQ ID NO: 24, or the complement thereof; positions 980-983 according to SEQ ID NO: 29, or the complement thereof, wherein the sequenced portion of the GPR75 mRNA molecule in the biological sample is mutated and lacks an AAAG tetranucleotide at positions corresponding to positions 919-922 according to SEQ ID NO: 7; lacks an AAAG tetranucleotide at positions corresponding to positions 820-823 according to SEQ ID NO: 8; lacks an AAAG tetranucleotide at positions corresponding to positions 741-744 according to SEQ ID NO: 9; lacks an AAAG tetranucleotide at positions corresponding to positions 980-983 according to SEQ ID NO: 10;

Cys400fs and the sequenced portion comprises position 1,410 according to SEQ ID NO: 15, or the complement thereof; position 1,311 according to SEQ ID NO: 20, the complement thereof; position 1,232 according to SEQ ID NO: 25, or the complement thereof; or position 1,471 according to SEQ ID NO: 30, or the complement thereof, wherein the sequenced portion of the GPR75 mRNA molecule in the biological sample is mutated and comprises an insertion of a uracil at a position corresponding to position 1,410 according to SEQ ID NO: 15; comprises an insertion of a uracil at a position corresponding to position 1,311 according to SEQ ID NO: 20; comprises an insertion of a uracil at a position corresponding to position 1,232 according to SEQ ID NO: 25; comprises an insertion of a uracil at a position corresponding to position 1,471 according to SEQ ID NO: 30;

Tyr207Cys and the sequenced portion comprises position 830 according to SEQ ID NO: 100, or the complement thereof; position 731 according to SEQ ID NO: 101, or the complement thereof; position 652 according to SEQ ID NO: 102, or the complement thereof; or position 891 according to SEQ ID NO: 103, or the complement thereof, wherein the sequenced portion of the GPR75 mRNA molecule in the biological sample is mutated and comprises a guanine at a position corresponding to position 830 according to SEQ ID NO: 100; comprises a guanine at a position corresponding to position 731 according to SEQ ID NO: 101; comprises a guanine at a position corresponding to position 652 according to SEQ ID NO: 102; or comprises a guanine at a position corresponding to position 891 according to SEQ ID NO: 103.

8. The method according to claim 4, wherein the sequence analysis comprises sequencing at least a portion of the nucleotide sequence of the GPR75 cDNA molecule in the biological sample, wherein the sequenced portion comprises a position corresponding to mutation:

Ala110fs and the sequenced portion comprises positions 539-545 according to SEQ ID NO: 35, or the complement thereof; positions 440-446 according to SEQ ID NO: 40, or the complement thereof; positions 361-367 according to SEQ ID NO: 45, or the complement thereof; positions 600-606 according to SEQ ID NO: 50, or the complement thereof, wherein the sequenced portion of the GPR75 cDNA molecule in the biological sample is mutated and lacks a CCAGTAG heptanucleotide at positions corresponding to positions 539-545 according to SEQ ID NO: 31; lacks a CCAGTAG heptanucleotide at positions corresponding to positions 440-446 according to SEQ ID NO: 32; lacks a CCAGTAG heptanucleotide at positions corresponding to positions 361-367 according to SEQ ID NO: 33; lacks a CCAGTAG heptanucleotide at positions corresponding to positions 600-606 according to SEQ ID NO: 34;

Ala116Thr and the sequenced portion comprises position 556 according to SEQ ID NO: 36, or the complement thereof; position 457 according to SEQ ID NO: 41, or the complement thereof; position 378 according to SEQ ID NO: 46, or the complement thereof; position 617 according to SEQ ID NO: 51, or the complement thereof, wherein the sequenced portion of the GPR75 cDNA molecule in the biological sample is mutated and comprises an adenine at a position corresponding to position 556 according to SEQ ID NO: 36; comprises an adenine at a position corresponding to position 457 according to SEQ ID NO: 41; comprises an adenine at a position corresponding to position 378 according to SEQ ID NO: 46; comprises an adenine at a position corresponding to position 617 according to SEQ ID NO: 51;

Gln234Stop and the sequenced portion comprises position 910 according to SEQ ID NO: 37, or the complement thereof; position 811 according to SEQ ID NO: 42, or the complement thereof; position 732 according to SEQ ID NO: 47, or the complement thereof; position 971 according to SEQ ID NO: 52, or the complement thereof, wherein the sequenced portion of the GPR75 cDNA molecule in the biological sample is mutated and comprises a thymine at a position corresponding to position 910 according to SEQ ID NO: 37; comprises a thymine at a position corresponding to position 811 according to SEQ ID NO: 42; comprises a thymine at a position corresponding to position 732 according to SEQ ID NO: 47; comprises a thymine at a position corresponding to position 971 according to SEQ ID NO: 52;

Arg236fs and the sequenced portion comprises positions 919-922 according to SEQ ID NO: 38, or the complement thereof; positions 820-823 according to SEQ ID NO: 43, or the complement thereof; positions 741-744 according to SEQ ID NO: 48, or the complement thereof; positions 980-983 according to SEQ ID NO: 53, or the complement thereof, wherein the sequenced portion of the GPR75 cDNA molecule in the biological sample is mutated and lacks an AAAG tetranucleotide at positions corresponding to positions 919-922 according to SEQ ID NO: 31; lacks an AAAG tetranucleotide at positions corresponding to positions 820-823 according to SEQ ID NO: 32; lacks an AAAG tetranucleotide at positions corresponding to positions 741-744 according to SEQ ID NO: 33; lacks an AAAG tetranucleotide at positions corresponding to positions 980-983 according to SEQ ID NO: 34;

Cys400fs and the sequenced portion comprises position 1,410 according to SEQ ID NO: 39, or the complement thereof; position 1,311 according to SEQ ID NO: 44, or the complement thereof; position 1,232 according to SEQ ID NO: 49, or the complement thereof; position 1,471 according to SEQ ID NO: 54, or the complement thereof, wherein the sequenced portion of the GPR75 cDNA molecule in the biological sample is mutated and comprises an insertion of a thymine at a position corresponding to position 1,410 according to SEQ ID NO: 39; comprises an insertion of a thymine at a position corresponding to position 1,311 according to SEQ ID NO: 44; comprises an insertion of a thymine at a position corresponding to position 1,232 according to SEQ ID NO: 49; or comprises an insertion of a thymine at a position corresponding to position 1,471 according to SEQ ID NO: 54; or Tyr207Cys and the sequenced portion comprises position 830 according to SEQ ID NO: 104, or the complement thereof; position 731 according to SEQ ID NO: 105, or the complement thereof; position 652 according to SEQ ID NO: 106, or the complement thereof; or position 891 according to SEQ ID NO: 107, or the complement thereof, wherein the sequenced portion of the GPR75 cDNA molecule in the biological sample is mutated and comprises a guanine at a position corresponding to position 830 according to SEQ ID NO: 104; comprises a guanine at a position corresponding to position 731 according to SEQ ID NO: 105; comprises a guanine at a position corresponding to position 652 according to SEQ ID NO: 106; or comprises a guanine at a position corresponding to position 891 according to SEQ ID NO: 107.

9. The method according to claim 6, wherein the sequence analysis comprises:
   a) contacting the GPR75 genomic nucleic acid molecule in the biological sample with a primer hybridizing to a portion of the nucleotide sequence that is proximate to the corresponding genomic positions;
   b) extending the primer at least through the position of the nucleotide sequence of the GPR75 genomic nucleic acid molecule corresponding to the genomic positions; and
   c) determining whether the extension product of the primer provides the mutation.

10. The method according to claim 7, wherein the sequence analysis comprises:
    a) contacting the GPR75 mRNA molecule in the biological sample with a primer hybridizing to a portion of the nucleotide sequence that is proximate to the corresponding mRNA positions;
    b) extending the primer at least through the position of the nucleotide sequence of the GPR75 mRNA molecule corresponding to the mRNA positions; and
    c) determining whether the extension product of the primer provides the mutation.

11. The method according to claim 8, wherein the sequence analysis comprises:
    a) contacting the GPR75 cDNA molecule in the biological sample with a primer hybridizing to a portion of the nucleotide sequence that is proximate to a position corresponding to the cDNA positions;
    b) extending the primer at least through the position of the nucleotide sequence of the GPR75 cDNA molecule corresponding to the cDNA positions; and
    c) determining whether the extension product of the primer provides the mutation.

12. The method according to claim 6, wherein the sequence analysis comprises sequencing the entire nucleic acid molecule.

13. The method according to claim 6, wherein the sequence analysis comprises:
    a) amplifying at least a portion of the genomic nucleic acid molecule that encodes the human GPR75 polypeptide and comprises the corresponding nucleic acid positions;
    b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising the mutation; and d) detecting the detectable label.

14. The method according to claim 7, wherein the sequence analysis comprises:

a) amplifying at least a portion of the mRNA molecule that encodes the human GPR75 polypeptide and comprises the corresponding nucleic acid positions;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising the mutation; and d) detecting the detectable label.

15. The method according to claim 8, wherein the sequence analysis comprises:

a) amplifying at least a portion of the cDNA molecule that encodes the human GPR75 polypeptide and comprises the corresponding nucleic acid positions;

b) labeling the amplified nucleic acid molecule with a detectable label;

c) contacting the labeled nucleic acid molecule with a support comprising an alteration-specific probe, wherein the alteration-specific probe comprises a nucleotide sequence which hybridizes under stringent conditions to the nucleic acid sequence of the amplified nucleic acid molecule comprising the mutation; and d) detecting the detectable label.

16. The method according to claim 15, wherein the cDNA is reverse-transcribed from mRNA prior to the amplifying step.

17. The method according to claim 6, wherein the sequence analysis comprises:

a) contacting the genomic nucleic acid molecule in the biological sample with an alteration-specific probe comprising a detectable label, wherein the alteration-specific probe comprises a nucleotide sequence which hybridizes under stringent conditions to the nucleotide sequence of the amplified nucleic acid molecule corresponding to the nucleic acid positions and comprising the mutation; and b) detecting the detectable label.

18. The method according to claim 7, wherein the sequence analysis comprises:

a) contacting the mRNA molecule in the biological sample with an alteration-specific probe comprising a detectable label, wherein the alteration-specific probe comprises a nucleotide sequence which hybridizes under stringent conditions to the nucleotide sequence of the amplified nucleic acid molecule corresponding to the nucleic acid positions and comprising the mutation; and b) detecting the detectable label.

19. The method according to claim 8, wherein the sequence analysis comprises:

a) contacting the cDNA molecule in the biological sample with an alteration-specific probe comprising a detectable label, wherein the alteration-specific probe comprises a nucleotide sequence which hybridizes under stringent conditions to the nucleotide sequence of the amplified nucleic acid molecule corresponding to the nucleic acid positions and comprising the mutation; and b) detecting the detectable label.

20. The method according to claim 1, wherein the nucleic acid molecule is present within a cell obtained from the subject.

21. The method according to claim 1, wherein the inhibitor of nucleic acid encoding GPR75 expression comprises an inhibitory nucleic acid molecule.

22. The method according to claim 21, wherein the inhibitory nucleic acid molecule is an antisense nucleic acid molecule, a small interfering RNA (siRNA), or a short hairpin RNA (shRNA) that hybridizes to a GPR75 mRNA.

23. The method according to claim 1, wherein the inhibitor of nucleic acid encoding GPR75 expression comprises a Cas protein and guide RNA (gRNA) that hybridizes to a gRNA recognition sequence within a GPR75 genomic nucleic acid molecule.

24. The method according to claim 23, wherein the Cas protein is Cas9 or Cpf1.

25. The method according to claim 23, wherein the gRNA recognition sequence includes or is proximate to a position corresponding to: position 5,540-5,546 according to SEQ ID NO: 1, position 5,557 according to SEQ ID NO: 1, position 5,911 according to SEQ ID NO: 1, positions 5,920-5,923 according to SEQ ID NO: 1, position 6,411 according to SEQ ID NO: 1 or position 5,831 according to SEQ ID NO: 1.

26. The method according to claim 23, wherein the gRNA recognition sequence is located from about 1000, from about 500, from about 400, from about 300, from about 200, from about 100, from about 50, from about 45, from about 40, from about 35, from about 30, from about 25, from about 20, from about 15, from about 10, or from about 5 nucleotides of a position corresponding to: position 5,540-5,546 according to SEQ ID NO: 1, position 5,557 according to SEQ ID NO: 1, position 5,911 according to SEQ ID NO: 1, positions 5,920-5,923 according to SEQ ID NO: 1, position 6,411 according to SEQ ID NO: 1, or position 5,831 according to SEQ ID NO: 1.

27. The method according to claim 23, wherein a Protospacer Adjacent Motif (PAM) sequence is about 2 to 6 nucleotides downstream of the gRNA recognition sequence.

28. The method according to claim 23, wherein the gRNA comprises from about 17 to about 23 nucleotides.

29. The method according to claim 23, wherein the gRNA recognition sequence comprises a nucleotide sequence according to any one of SEQ ID NOS:61-98.

* * * * *